United States Patent
Lowe et al.

(10) Patent No.: US 11,673,931 B2
(45) Date of Patent: Jun. 13, 2023

(54) IMMUNOCYTOKINES FOR THE TREATMENT OF CANCER

(71) Applicant: PIERRE FABRE MEDICAMENT, Boulogne-Billancourt (FR)

(72) Inventors: Peter Lowe, Chazay Bons (FR); Jean-François Haeuw, Beaumont (FR); Alicia Contet, saint Julien en Genevois (FR); Céline Bertaux, Viry (FR); Barbara Akla, Cruseilles (FR); Marie-Claire Janin-Bussat, Saint Julien en Genevois (FR); Martine Malissard, Valserhône (FR); Juliette Trepreau, Saint Julien en Genevois (FR)

(73) Assignee: PIERRE FABRE MEDICAMENT, Boulogne-Billancourt (FR)

( * ) Notice: Subject to any disclaimer, the term of this patent is extended or adjusted under 35 U.S.C. 154(b) by 347 days.

(21) Appl. No.: 16/837,916

(22) Filed: Apr. 1, 2020

(65) Prior Publication Data

US 2020/0308242 A1 Oct. 1, 2020

Related U.S. Application Data

(63) Continuation-in-part of application No. PCT/EP2019/076471, filed on Sep. 30, 2019.

(60) Provisional application No. 62/738,391, filed on Sep. 28, 2018.

(30) Foreign Application Priority Data

Mar. 19, 2019 (EP) ..................... 19305336

(51) Int. Cl.
| | | |
|---|---|---|
| *C07K 14/54* | (2006.01) | |
| *C07K 14/56* | (2006.01) | |
| *C07K 16/28* | (2006.01) | |
| *A61K 38/00* | (2006.01) | |
| *C07K 16/44* | (2006.01) | |

(52) U.S. Cl.
CPC .......... *C07K 14/5443* (2013.01); *C07K 14/56* (2013.01); *C07K 16/2803* (2013.01); *C07K 16/2827* (2013.01); *C07K 16/2863* (2013.01); *C07K 16/44* (2013.01); *A61K 38/00* (2013.01); *C07K 2317/24* (2013.01); *C07K 2317/94* (2013.01); *C07K 2319/50* (2013.01); *C07K 2319/75* (2013.01)

(58) Field of Classification Search
CPC .............. C07K 14/5443; C07K 14/56; C07K 16/2827; C07K 16/2863; C07K 16/44; C07K 2317/24; C07K 2319/50
See application file for complete search history.

(56) References Cited

U.S. PATENT DOCUMENTS

| | | | |
|---|---|---|---|
| 5,246,019 A | | 9/1993 | Godfrey et al. |
| 5,530,101 A | | 6/1996 | Queen et al. |
| 5,585,089 A | | 12/1996 | Queen et al. |
| 5,639,641 A | | 6/1997 | Pedersen et al. |
| 5,693,761 A | | 12/1997 | Queen et al. |
| 5,772,997 A | | 6/1998 | Hudziak et al. |
| 5,792,632 A | | 8/1998 | Dujon et al. |
| 5,830,729 A | | 11/1998 | Jaisser et al. |
| 5,877,293 A | | 3/1999 | Adair et al. |
| 5,886,152 A | | 3/1999 | Nakatani et al. |
| 6,054,297 A | | 4/2000 | Carter et al. |
| 6,180,370 B1 | | 1/2001 | Queen et al. |
| 6,238,924 B1 | | 5/2001 | Dujon et al. |
| 2020/0207846 A1* | | 7/2020 | Igawa .................. C07K 16/244 |

FOREIGN PATENT DOCUMENTS

| | | |
|---|---|---|
| EP | 0682040 A1 | 11/1995 |
| EP | 0939127 A2 | 9/1999 |
| WO | WO 91/01753 A1 | 2/1991 |
| WO | WO 91/06279 A1 | 5/1991 |
| WO | WO 92/11018 A1 | 7/1992 |
| WO | WO 03/025183 A2 | 3/2003 |
| WO | WO 2004/067753 A2 | 8/2004 |
| WO | WO 2009/054985 A1 | 4/2009 |
| WO | WO 2018/156815 A1 | 8/2018 |

OTHER PUBLICATIONS

Helguer et al., Antibody-Cytokine Fusion Proteins: Harnessing the Combined Power of Cytokines and Antibodies for Cancer Therapy. Clinical Immunology 105 (3):233-246, 2002.*

Andersen et al., "Proximity Ligation Assay Combined with Flow Cytometry is a Powerful Tool for the Detection of Cytokine Receptor Dimerization," Cytokine, vol. 64, No. 1, Oct. 2013, pp. 54-57.

Bebbington et al., "High-Level Expression of a Recombinant Antibody from Myeloma Cells Using a•Glutamine Synthetase Gene as an Amplifiable Selectable Marker," Bio/Technology, vol. 10, Feb. 1992, pp. 169-175.

Beha et al., "IL 15-Based Trifunctional Antibody-Fusion Proteins with Costimulatory TNF-Superfamily Ligands in the Single-Chain Format for Cancer Immunotherapy," Molecular Cancer Therapeutics, vol. 18, No. 7, Jul. 2019 (Published Online Apr. 30, 2019), pp. 1278-1288 (12 pages total).

(Continued)

*Primary Examiner* — Ruixiang Li
(74) *Attorney, Agent, or Firm* — Birch, Stewart, Kolasch & Birch, LLP

(57) ABSTRACT

The present invention relates to new immunocytokines which are useful for the treatment of cancer. These fusion proteins comprise (i) an antibody or antigen-binding fragment thereof fused to (ii) a cleavable peptide linker, and (iii) cytokine, or functional fragments thereof. Methods of treatment using these immunocytokines are also disclosed.

11 Claims, 53 Drawing Sheets

Figure 1:
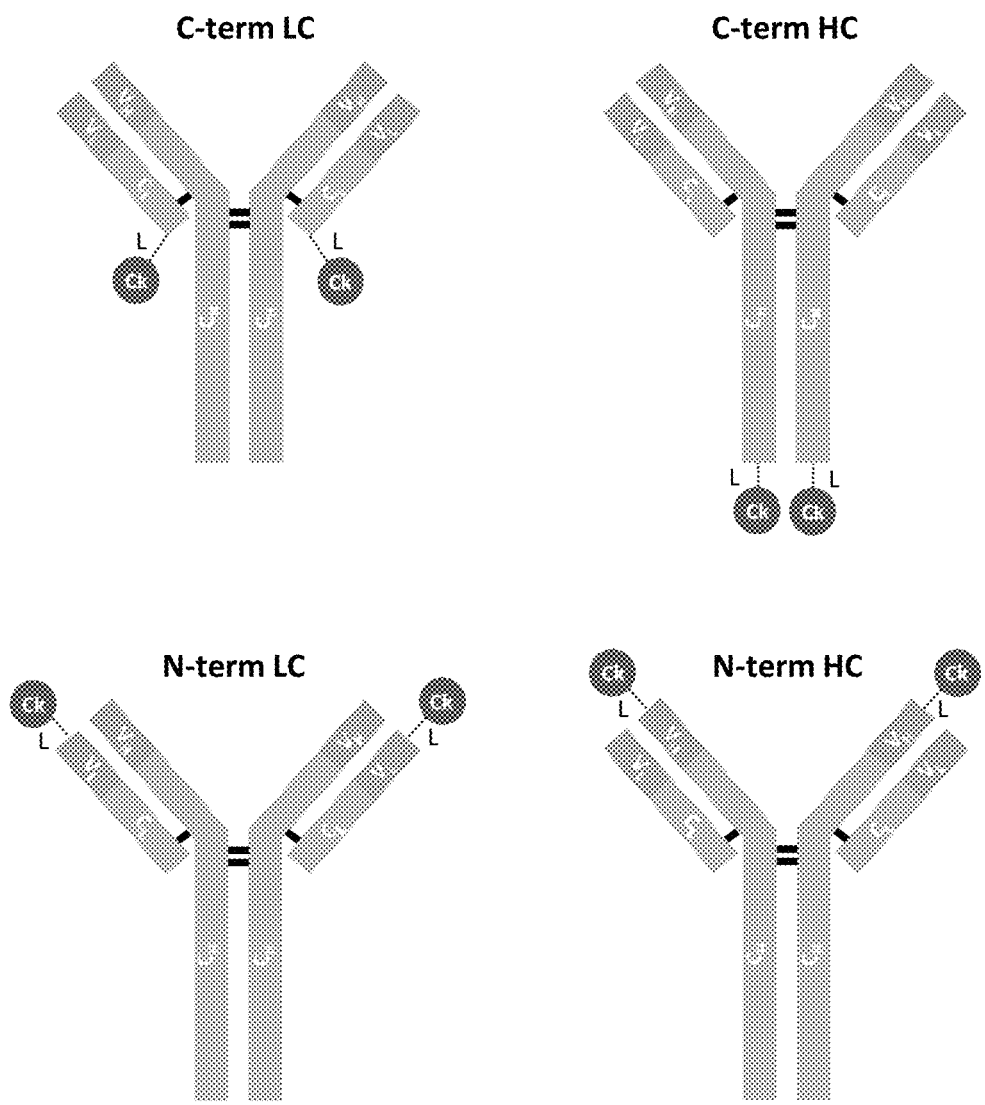

Specification includes a Sequence Listing.

(56) References Cited

OTHER PUBLICATIONS

Bessard et al., "High Antitumor Activity of RLI, an interleukin-15 (IL-15)-IL-15 Receptor α Fusion Protein, in Metastatic Melanoma and Colorectal Cancer," Molecular Cancer Therapeutics, vol. 8, No. 9, Sep. 2009 (Published Online Sep. 1, 2009), pp. 2736-2745, XP002636846.
Capece et al., "Targeting Costimulatory Molecules to Improve Antitumor Immunity," Journal of Biomedicine and Biotechnology, vol. 2012, Article ID 926321, 2012, pp. 1-17.
Cockett et al., "High Level Expression of Tissue Inhibitor of Metalloproteinases in Chinese Hamster Ovary Cells Using Glutamine Synthetase Gene Amplification," Bio/Technoiogy, vol. 8, Jul. 1990, pp. 662-667.
Compan et al., "Measuring IL-1β Processing by Bioluminescence Sensors I: Using a Bioluminescence Resonance Energy Transfer Biosensor," Methods in Molecular Biology, vol. 1417, 2016, pp. 89-95.
Crouse et al., "Expression and Amplification of Engineered Mouse Dihydrofolate Reductase Minigenes," Molecular and Cellular Biology, vol. 3, No. 2, Feb. 1983, pp. 257-266.
Desbois et al., "IL-15 Trans-Signaling with the Superagonist RLI Promotes Effector/Memory CD8+T Cell Responses and Enhances Antitumor Activity of PD-1 Antagonists," The Journal of Immunology, vol. 197, 2016 (Prepublished online May 23, 2016), pp. 168-178 (17 pages total).
Floros et al., "Anticancer Cytokines: Biology and Clinical Effects of IFN," Semin Oncol., vol. 42, No. 4, 2015, pp. 1-17.
Foecking et al., "Powerful and Versatile Enhancer-promoter Unit for Mammalian Expression Vectors," Gene, vol. 45, 1986, pp. 101-105.
He et al., "Enzyme-triggered, Cell Penetrating Peptide-mediated Delivery of Anti-tumor Agents," Journal of Controlled Release, vol. 240, 2016 (Available online Oct. 26, 2015), pp. 67-76.
Hess, "Targeted Delivery of Immunomodulatory Proteins: Evaluation of Novel Antibody-chemokine and Antibody-cytokine Fusion Proteins for Cancer Therapy," Doctoral Thesis, ETH Zurich Research Collection, Diss. ETH No. 22338, 2015, pp. 1-198 (204 pages total).
Invitation to Pay Additional Fee and, Where Applicable, Protest Fee (PCT/ISA/206) and Annex to Form PCT/ISA/206 Communication and Provisional Opinion Accompanying the Partial Search Results, dated Nov. 25, 2019, for International Application No. PCT/EP2019/076471.
Jones et al., "Replacing the Complementarity-determining Regions in a Human Antibody with Those from a Mouse," Nature, vol. 321, May 29, 1986, pp. 522-525.
Karin et al., "Chemokines Beyond Chemo-attraction: CXCL10 and Its Significant Role in Cancer and Autoimmunity," Cytokine, vol. 109, 2018, pp. 24-28.
Kermer et al., "Combining Antibody-Directed Presentation of IL-15 and 4-1BBL in a Trifunctional Fusion Protein for Cancer Immunotherapy," Molecular Cancer Therapeutics, vol. 13, No. 1, Jan. 2014 (Published Online Nov. 6, 2013), pp. 112-121 (11 pages total).
Kiefer et al., "Immunocytokines and Bispecific Antibodies: Two Complementary Strategies for the Selective Activation of Immune Ceils at the Tumor Site," Immunol Rev., vol. 270. No. 1, Mar. 2016, pp. 178-192 (27 pages total).
Köhler et al., "Continuous Cultures of Fused Cells Secreting Antibody of Predefined Specificity," The Journal of Immunology, vol. 174, 2005, pp. 2453-2455, reprinted with permission from Nature, vol. 256, Aug. 7, 1975, pp. 495-497 (4 pages total).
Kowalsky et al., "Superagonist IL-15-Armed Oncolytic Virus Elicits Potent Antitumor Immunity and Therapy That Are Enhanced with PD-1 Blockade," Molecular Therapy, vol. 26, No. 10, Oct. 2018, pp. 2476-2486, XP002794091.
Kyi et al., "Checkpoint Blocking Antibodies in Cancer Immunotherapy," FEBS Letters, vol. 588, 2014 (Available online Oct. 23, 2013), pp. 368-376.

Le Mercier et al., "Beyond CTLA-4 and PD-1, the Generation Z of Negative Checkpoint Regulators," Frontiers in Immunology, vol. 6, Article 418, Aug. 2015 (Published Aug. 21, 2015), pp. 1-15.
Lopez De Padilla et al., "The Type I Interferons: Basic Concepts and Clinical Relevance in Immune-mediated Inflammatory Diseases," Gene, vol. 576, No. 1, Part 1, Jan. 15, 2016, pp. 14-21 (20 pages total).
Lowy et al., "Isolation of Transformina DNA: Cloning the Hamster aprt Gene," Cell, vol. 22, Dec. 1980, pp. 817-823.
Moehle et al., "Targeted Gene Addition into a Specified Location in the Human Genome Using Designed Zinc Finger Nucleases," PNAS, vol. 104, No. 9, Feb. 27. 2007, pp. 3055-3060, with Corrections, PNAS Apr. 3, 2007, vol. 104, No. 14, pp. 6090 (7pages total).
Mountain et al., "Engineering Antibodies for Therapy," Biotechnology and Genetic Engineering Reviews, vol. 10, Dec. 1992, pp. 1-142 (143 pages total).
Mulligan et al., "Selection for Animal Cells that Express the *Escherichia coli* Gene Coding for Xanthine-Guanine Phosphoribosyltransferase," Proc. Natl. Acad. Sci. USA, vol. 78, No. 4, Apr. 1981, pp. 2072-2076.
Murrieta-Coxca et al., "IL-36 Cytokines: Regulators of Inflammatory Responses and Their Emerging Role in Immunology of Reproduction," International Journal of Molecular Sciences, vol. 20, No. 7, 2019 (Published Apr. 3, 2019), pp. 1-24.
Pachella et al., "The Toxicity and Benefit of Various Dosing Strategies for Interleukin-2 in Metastatic Melanoma and Renal Cell Carcinoma," J Adv Pract Oncol, vol. 6, No. 3, May/Jun. 2015, pp. 212-221.
Pardoll, "The Blockade of Immune Checkpoints in Cancer Immunotherapy," Nature Reviews, vol. 12, Apr. 2012, pp. 252-264.
Pasche el al., "Immunocytokines: A Novel Class of Potent Armed Antibodies," Drug Discovery Today, vol. 17, Nos. 11-12, Jun. 1, 2012, pp. 583-590, XP055079479.
Reik et al., "Enhanced Protein Production by Engineered Zinc Finger Proteins," Biotechnology and Bioengineering, vol. 97, No. 5, Aug. 1, 2007 (Published online Dec. 14, 2006), pp. 1180-1189.
Riechmann et al., "Reshaping Human Antibodies for Therapy," Nature, vol. 332, Mar. 24, 1988, pp. 323-327.
Robinson et al., "The Potential and Promise of IL-15 in immuno-oncogenic Therapies," Immunol Lett., vol. 190, 2017, pp. 1-22.
Santerre et al., "Expression of Prokaryotic Genes for Hygromycin B and G418 Resistance as Dominant-Selection Markers in Mouse L Cells," Gene, vol. 30, 1984, pp. 147-156.
Schmohl et al., "Tetraspecific ScFv Construct Provides NK Cell Mediated ADCC and Self-sustaining Stimuli via Insertion of IL-15 as a Cross-linker," Oncotarget, vol. 7, No. 45. Published Sep. 16. 2016, pp. 73830-73844, XP002794092.
Singer et al., "Optimal Humanization of 1B4, an Anti-CD18 Murine Monoclonal Antibody, Is Achieved by Correct Choice of Human V-Region Framework Sequences," The Journal of Immunology, vol. 150, Apr. 1, 1993, pp. 2844-2857.
Skrombolas et al., "Challenges and Developing Solutions for Increasing the Benefits of IL-2 Treatment in Tumor Therapy," Expert Rev Clin Immunol. vol. 10, No. 2, Feb. 2014, pp. 207-217 (20 pages total).
Skrombolas et al., "Development of an Interleukin-12 Fusion Protein That Is Activated by Cleavage with Matrix Metalloproteinase 9," Journal of Interferon & Cytokine Research, vol. 39, No. 4. 2019, pp. 233-245, XP055617771.
Sondel et al., "Current and Potential Uses of Immunocytokines as Cancer Immunotherapy," Antibodies (Basel), vol. 1, No. 2, Jul. 4, 2012, pp. 149-171 (27 pages total).
Szybalska et al., "Genetics of Human Cell Lines, IV. DNA-Mediated Heritable Transformation of a Biochemical Trait," Proc Natl Acad Sci USA, vol. 48, 1962, 2026-2034.
Van Der Veldt et al., "Toward Prediction of Efficacy of Chemotherapy: A Proof of Concept Study in Lung Cancer Patients Using [$^{11}$C]docetaxel and Positron Emission Tomography," Clin Cancer Res, vol. 19, 2013 (Published Online Apr. 25, 2013), pp. 4163-4173 (12 pages total).
Verhoeyen et al., "Engineering of Antibodies," BioEssays, vol. 8, No. 2, Feb./Mar. 1988, pp. 74-78.

(56) References Cited

OTHER PUBLICATIONS

Verhoeyen et al., "Reshaping Human Antibodies: Grafting an Antilysozyme Activity," Science, vol. 239, 1988, pp. 1534-1536.

Vincent et al., "Antitumor Activity of an immunocytokine Composed of an Anti-GD2 Antibody and the IL-15 Superagonist RLI," OncoImmunology, vol. 2, No. 11, 2013, pp. e26441-1 to e26441-3, XP002794090.

Vincent et al., "Highly Potent Anti-CD20-RLI Immunocytokine Targeting Established Human B Lymphoma in SCID Mouse," MABS, vol. 6, Issue 4, Apr. 7, 2014, pp. 1026-1037 (13 pages total), XP055618642.

Vincent et al.. "Tumor Targeting of the IL-15 Superagonist RLI by an Anti-GD2 Antibody Strongly Enhances its Antitumor Potency," Int. J. Cancer, vol. 133, No. 3, 2013 (Aug. 1, 2013), pp. 757-766, XP055151554.

Waldmann et al., "IL-15," Cytokine Reference, Academic Press, 2001, pp. 213-223 (13 pages total).

Waldmann, "The Biology of IL-15: Implications for Cancer Therapy and the Treatment of Autoimmune Disorders," Journal of Investigative Dermatology Symposium Proceedings, vol. 16, vol. 1, 2013, pp. 528-530.

Wigler et al., "Transfer of Purified Herpes Virus Thymidine Kinase Gene to Cultured Mouse Cells," Cell, vol. 11, May 1977, pp. 223-232.

Wigler et al., "Transformation of Mammalian Cells with an Amplifiable Dominant-acting Gene," Proc. Natl. Acad. Sci. vol. 77, No. 6, Jun. 1980, pp. 3567-3570.

WU et al., "Delivery Systems for Gene Therapy," Biotherapy, vol. 3, 1991, pp. 87-95.

\* cited by examiner

| | Target | IGF-1R | PD-L1 | Histone-H1 | *OmpA* |
|---|---|---|---|---|---|
| | mAb | Ganitumab (H16/L16) | Atezolizumab | NHS76 | *c9G4* |
| | Fusion site | Heavy chain | | | |
| Cytokine | IL-2 | | N-term / C-term | | |
| | IL-15 | C-term | | C-term | C-term |
| | IFNa2a | C-term | | C-term | C-term |
| | CCL4 | N-term | | N-term | C-term |
| | CXCL9 | N-term | | N-term / C-term | C-term |
| | CXCL10 | N-term | | N-term / C-term | C-term |
| | Linker | PVGLIG | | | |

A

B

Figure 7
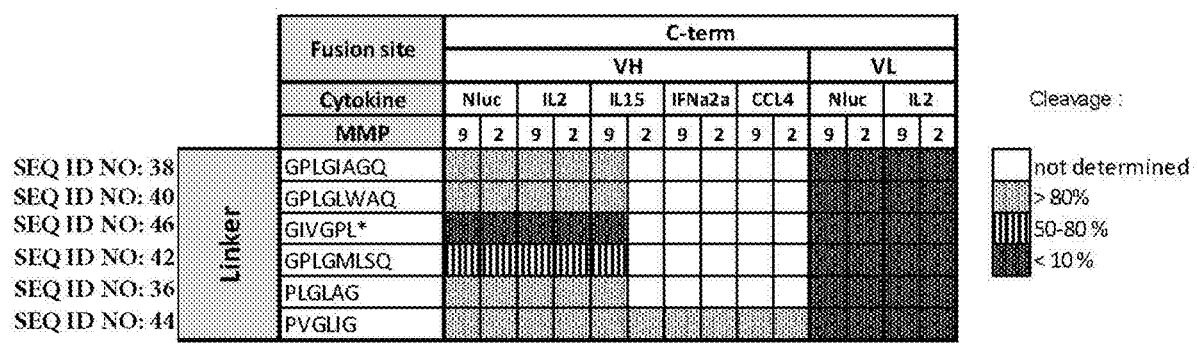
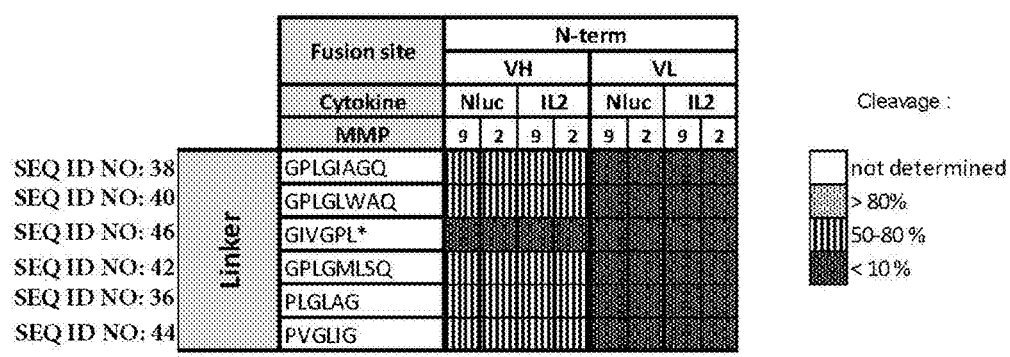

Figure 32

| Molecule code | Name | Antibody | Linker type | Isotype | Cofactor | Cofactor expression |
|---|---|---|---|---|---|---|
| AB56 | hH16L16(hG4dK)_(hK) | hH16L16 | No | IgG4PdK | No | No |
| K00901-006 | m9G4(hG1dK-L6-IL-15)_(hK) | m9G4 | PVGLIG | IgG1dK | No | No |
| K03001-002 | hNHS76(hIgG1dK-L6-IL-15)_(hL) | hNHS76 | PVGLIG | IgG1dK | No | No |
| K03001-023 | hNHS76(hIgG1dK-L6-IL-15)_(hL)+sushi+ | hNHS76 | PVGLIG | IgG1dK | sushi+ | Co-expression |
| K03001-024 | hNHS76(hIgG1dK-L6-IL-15)_(hL)+ sIL-15Rα | hNHS76 | PVGLIG | IgG1dK | sIL-15Rα | Co-expression |
| K03001-025 | hNHS76(hIgG4PdK-L6-IL-15)_(hL)+sushi+ | hNHS76 | PVGLIG | IgG4PdK | sushi+ | Co-expression |
| K03001-026 | hNHS76(hIgG4PdK-L6-IL-15)_(hL)+ sIL-15Rα | hNHS76 | PVGLIG | IgG4PdK | sIL-15Rα | Co-expression |
| K03201-001 | hH16L16(hG1dK)_(hK) | hH16L16 | No | IgG1dK | No | No |
| K03201-002 | hH16L16(hG1dK-L6-IL-15)_(hK) | hH16L16 | PVGLIG | IgG1dK | No | No |
| K03201-027 | hH16/L16 (hG1dK-PVGLIG-IL-15)(hk) + sIL-15Rα | hH16L16 | PVGLIG | IgG1dK | sIL-15Rα | Co-expression |
| K03201-029 | m9G4(hIgG1PdK-L6-IL-15)_(hk)+ sIL-15Rα | m9G4 | PVGLIG | IgG1dK | sIL-15Rα | Co-expression |
| K03201-034 | hH16L16 (hG1dK-L6-IL-15-nc30-Sushi) (hk) | hH16L16 | PVGLIG | IgG1dK | sushi | Covalent |
| K03201-046 | hH16L16(hIgG1dK-L6L6-IL-15[nc30-Sushi])_(hK) | hH16L16 | PVGLI GPVG LIG | IgG1dK | sushi | Covalent |
| K03201-061 | hH16L16(hIgG1dK-SGRSA-IL-15)_(hk) | hH16L16 | SGRSA | IgG1dK | Non | non |
| K03201-069 | hH16L16(hG1dK-L6-IL-15[nc30-sushi+])_(hK) | hH16L16 | PVGLIG | IgG1dK | sushi+ | Covalent |
| K03201-070 | hH16L16(hG1dK-L6-L6-IL-15)_(hK)+ sIL-15Rα | hH16L16 | PVGLI GPVG LIG | IgG1dK | sIL-15Rα | Co-expression |
| K03201-071 | hH16L16(hG1dK-L6-L6-IL-15)_(hK) + sushi+ | hH16L16 | PVGLI GPVG LIG | IgG1dK | sushi+ | Co-expression |
| K03201-072 | hH16L16(hG1dK-L6-L6-IL-15[nc30-sushi+])_(hK) | hH16L16 | PVGLI GPVG LIG | IgG1dK | sushi+ | Covalent |
| K03201-073 | hH16L16(hG4PdK-L6-IL-15)_(hK) | hH16L16 | PVGLIG | IgG4PdK | No | No |

Figure 32 (cont'd)

| Molecule code | Name | Antibody | Linker type | Isotype | Cofactor | Cofactor expression |
|---|---|---|---|---|---|---|
| K03201-074 | hH16L16(hG4PdK-L6-IL-15[nc30-Sushi])_(hK) | hH16L16 | PVGLIG | IgG4PdK | sushi | Covalent |
| K03201-075 | hH16L16(hG4PdK-L6-IL-15[nc30-Sushi+])_(hK) | hH16L16 | PVGLIG | IgG4PdK | sushi+ | Covalent |
| K03201-076 | hH16L16(hIgG1dK-L6-L6-IL-15)_(hk) | hH16L16 | PVGLIGPVGLIG | IgG1dK | No | No |
| K03201-077 | hH16L16(hG1dK-L6-IL-15)_(hk) + sushi+ | hH16L16 | PVGLIG | IgG1dK | sushi+ | Co-expression |
| K03201-078 | hH16L16(hG4PdK-L6-IL-15)_(hK) +sIL-15Rα | hH16L16 | PVGLIG | IgG4PdK | sIL-15Rα | Co-expression |
| K03201-079 | hH16L16(hG4PdK-L6-IL-15)_(hK) +sushi+ | hH16L16 | PVGLIG | IgG4PdK | sushi+ | Co-expression |
| K03201-086 | m9G4(hIgG1PdK-L6-IL-15)_(hk)+sushi+ | m9G4 | PVGLIG | IgG1dK | sushi+ | Co-expression |
| K03201-087 | m9G4(hIgG1dK-L6-L6-IL-15)_(hk)+sushi+ | m9G4 | PVGLIGPVGLIG | IgG1dK | sushi+ | Co-expression |
| K03201-089 | hH16L16(hG4PdK-L6-L6-IL-15)_(hK)+ sIL-15Rα | hH16L16 | PVGLIGPVGLIG | IgG4PdK | sIL-15Rα | Co-expression |
| K03201-090 | hH16L16(hG4PdK-L6-L6-IL-15)_(hK) + sushi+ | hH16L16 | PVGLIGPVGLIG | IgG4PdK | sushi+ | Co-expression |
| K03201-091 | m9G4(hIgG1dK-L6-L6-IL-15)_(hk)+ sIL-15Rα | m9G4 | PVGLIGPVGLIG | IgG1dK | sIL-15Rα | Co-expression |
| K03201-092 | m9G4(hIgG4PdK-L6-L6-IL-15)_(hk)+sushi+ | m9G4 | PVGLIGPVGLIG | IgG4PdK | sushi+ | Co-expression |
| K03201-093 | m9G4(hIgG4PdK-L6-L6-IL-15)_(hk)+ sIL-15Rα | m9G4 | PVGLIGPVGLIG | IgG4PdK | sIL-15Rα | Co-expression |
| K03201-094 | m9G4(hIgG4PdK-L6-IL-15)_(hk)+sushi+ | m9G4 | PVGLIG | IgG4PdK | sushi+ | Co-expression |
| K03201-095 | m9G4(hIgG4PdK-L6-IL-15)_(hk)+ sIL-15Rα | m9G4 | PVGLIG | IgG4PdK | sIL-15Rα | Co-expression |
| K03201-099 | hH16L16(hIgG1dK-SGRSA-IL-15)_(hk)+ sushi + | hH16L16 | SGRSA | IgG1dK | sushi+ | Co-expression |
| K03201-100 | hH16L16(hIgG1dK-SGRSA-IL-15)_(hk)+ sIL-15Rα | hH16L16 | SGRSA | IgG1dK | sIL-15Rα | Co-expression |

IMMUNOCYTOKINES FOR THE TREATMENT OF CANCER

CROSS REFERENCES TO RELATED APPLICATIONS

This application is a Continuation-in-Part of PCT International Application No. PCT/EP2019/076471, filed on Sep. 30, 2019, which claims priority under 35 U.S.C. 119(e) to U.S. Provisional Application No. 62/738,391, filed on Sep. 28, 2018 and under 35 U.S.C. 119(a) to patent application Ser. No. 19/305,336.0, filed in Europe on Mar. 19, 2019, all of which are hereby expressly incorporated by reference into the present application.

INTRODUCTION

The invention relates to a new immunocytokines and protein complexes comprising these immunocytokines. It also relates to the use or these molecules for treating cancer.

While therapeutic success has been achieved for various types of haematological malignancies and some solid tumours (e.g., metastatic testicular cancer), the majority of disseminated forms of solid cancer remain incurable. The therapeutic efficacy of conventional cancer therapeutics is often limited by the inability of small organic molecules to accumulate in sufficient amounts at the site of disease (see e.g., van der Veldt A A, et al. *Clin Cancer Res.* 19: 4163-4173, 2013).

New strategies are now developed that preferentially activate relevant immune subsets, such as T effectors, monocytes and NK cells, while limiting the activation of regulatory T cells. However, substantial side effects and unfavourable pharmacokinetic properties have been a major drawback hampering the administration of therapeutically relevant doses. Notably, cytokine immunotherapy often results in the development of severe dose-limiting side effects (Pachella et al., *Pract Oncol* 6:212-221, 2015). Two properties shared by most cytokines are thought to play a crucial role in the development of treatment-associated adverse effects. Firstly, cytokines are pleiotropic, meaning they are able to influence more than a single cell type. Furthermore, cytokines have a short serum half-life and, thus, need to be administered at high doses to achieve their therapeutic effects. While effectively enhancing therapeutic efficacy, high doses exacerbate pleiotropic activities that manifest as adverse effects in patients.

One approach aimed at increasing efficacy attempts to deliver cytokines to tumour sites by genetically fusing cytokines to antibodies, or antibody components such as a single chain variable fragment (scFv). Such fusion proteins, designated immunocytokines, combine the binding specificity of an antibody with the potency of cytokines such as, for example, IL-2 (Sondel t Gillies, *Antibodies* 1: 149-171, 2012; Skrombolas & Frelinger, *Expert Rev Clin Immunol.* 10(2): 207-217, 2014; Kiefer & Neri, *Immunol Rev.* 270(1): 178-192, 2016). Delivery of the cytokine to the tumour site is improved by the use of immunocytokines, notably for cancers with easily accessible tumours. In another instance, the immunocytokine comprises a cytokine (IL-12) joined to a specific inhibitory anti-IL-12 scFv by a MMP9-cleavage site (Skrombolas et al., *J Interferon Cytokine Res.* 39(4): 233-245, 2019). However, the treatment of disseminated, systemic diseases might benefit from immunocytokines that have been optimised for tumour targeting and activation at the tumour site (Sondel t Gillies, *Antibodies* 1: 149-171, 2012). In particular, binding of the antibody outside of the tumour may result in unwanted cytokine activity and potential side effects. This problem is all the more crucial as certain payloads have been reported to completely abrogate the tumour-targeting potential of the parental antibody in mouse models of cancer (see e.g., Hess, Doctoral Thesis, ETH Zürich, 2015).

Thus, there is still a need for an immunocytokine which can deliver and activate the cytokine safely and efficiently to the tumour site.

FIGURE LEGENDS

FIG. 1. Fusion sites for generating immunocytokines (ICC).

Figure 2:
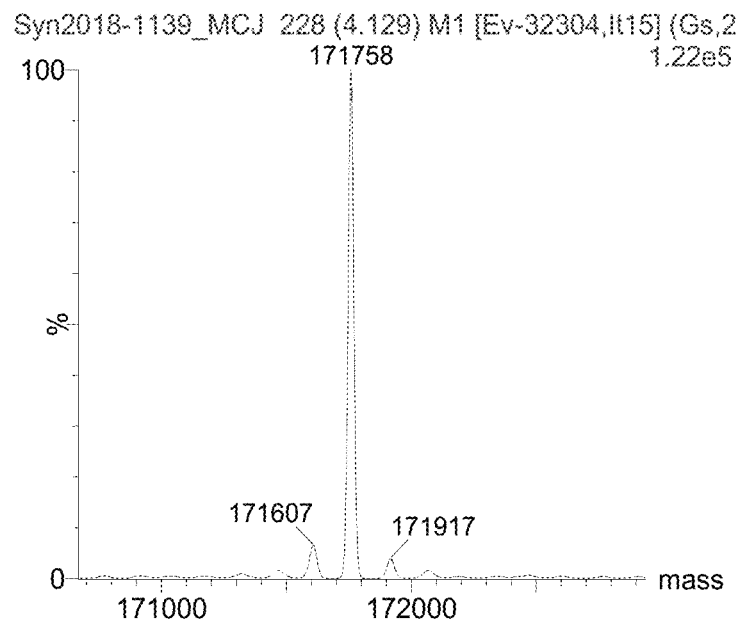

FIG. 2: Deconvoluted MS spectrum of c9G4PVGLIG-IL-15 obtained after deglycosylation RP-LC separation.

Figure 3:
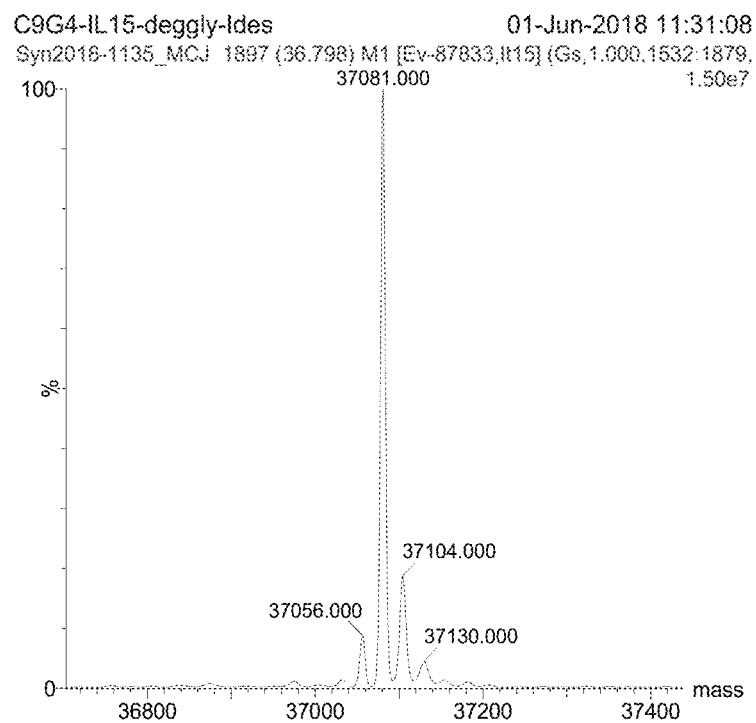

FIG. 3: Deconvoluted MS spectrum of Fcl2 cG4PVGLIG-IL-15 obtained after deglycosylation, IdEs digestion and RP-LC separation.

Figure 4:
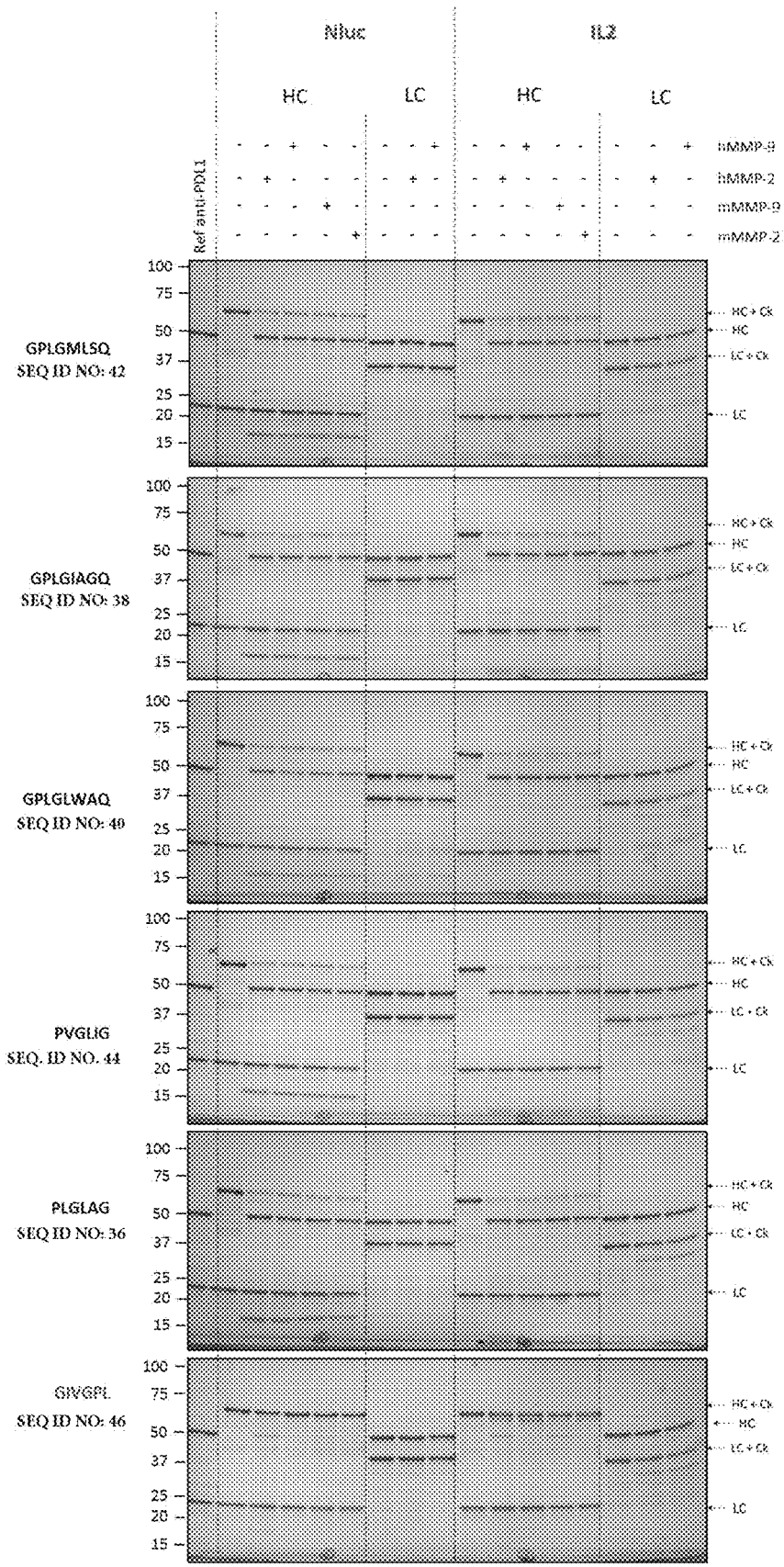

FIG. 4. Evaluation of MMP-9/2 linkers cleavability when fused to the C-terminus of a mAb heavy chain. The GIVGPL linker (SEQ ID NO: 46) reported as non-cleavable by MMP-9/2 was used as negative control for cleavage specificity.

Figure 5:
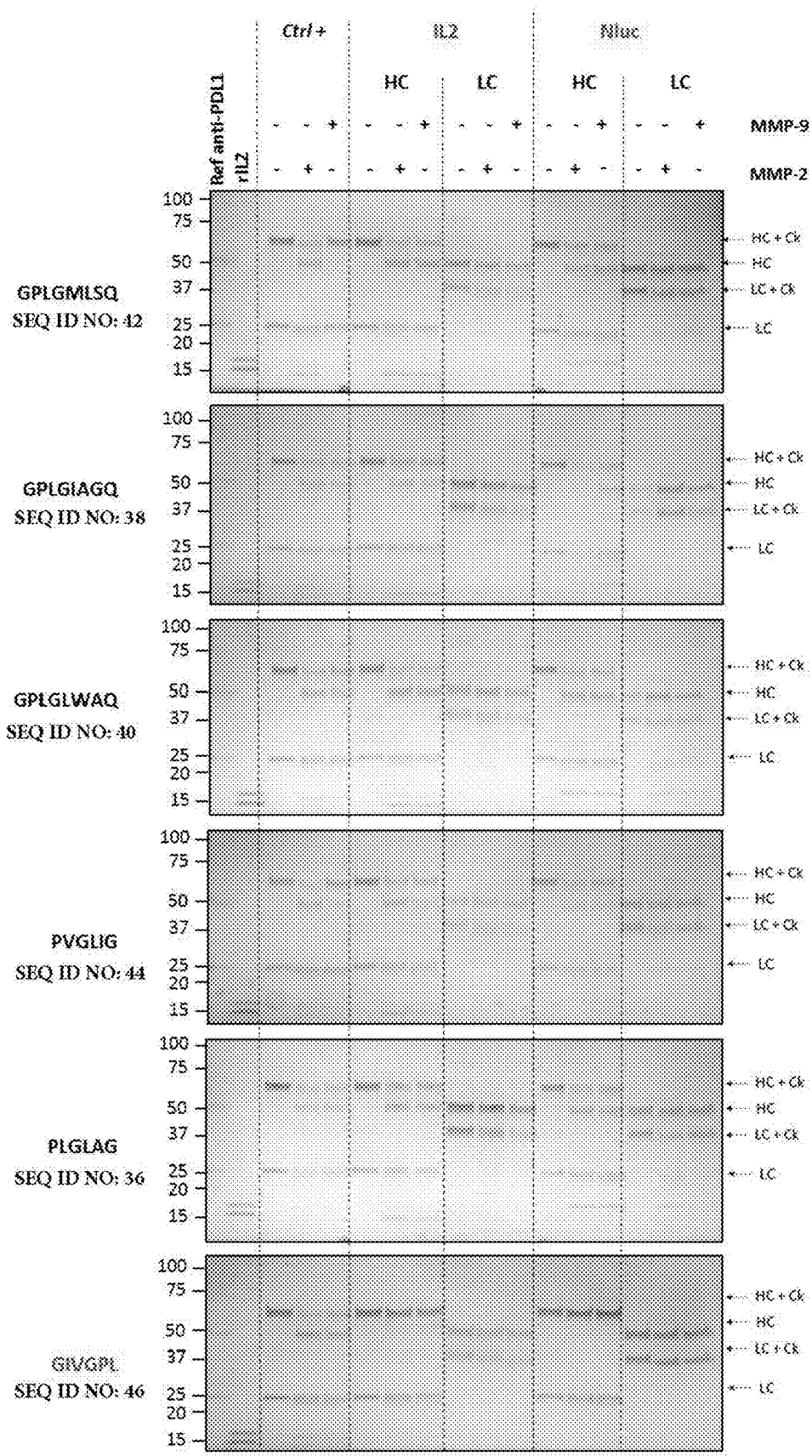

FIG. 5. Evaluation of MMP-9/2 linkers cleavability when fused to the N-terminus of a mAb heavy chain. The GIVGPL linker (SEQ ID NO: 46) reported as non-cleavable by MMP-9/2 was used as negative control for cleavage specificity. HC: Heavy Chain, LC: Light Chain, Ck: Cytokine.

Figure 6:
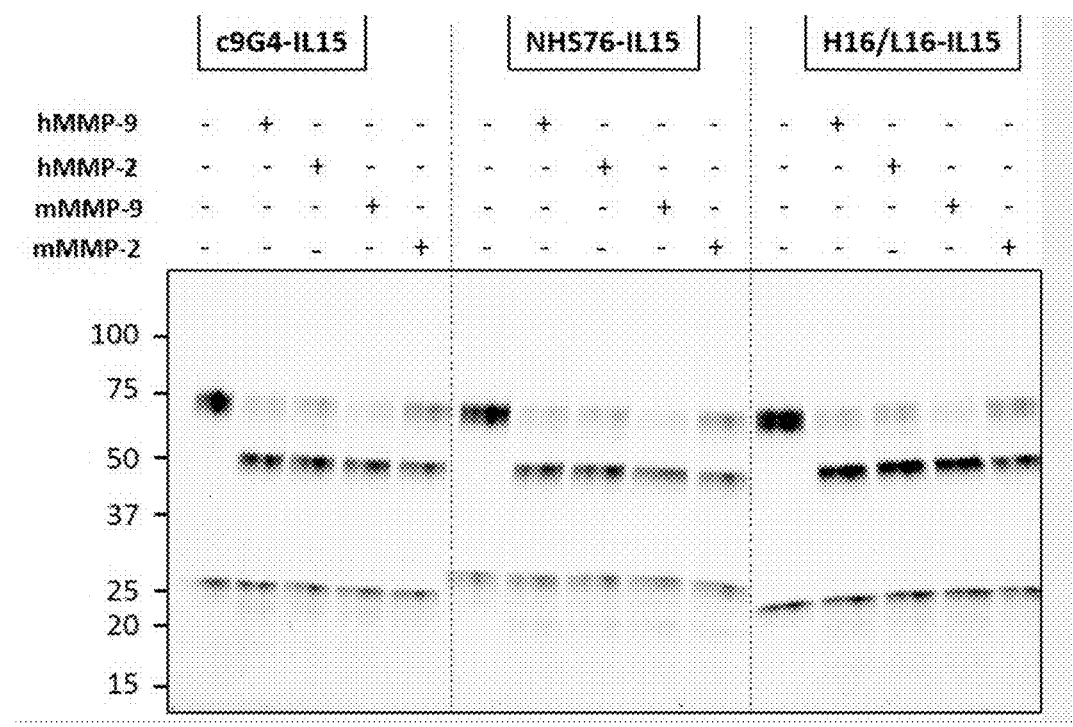
Figure 6:
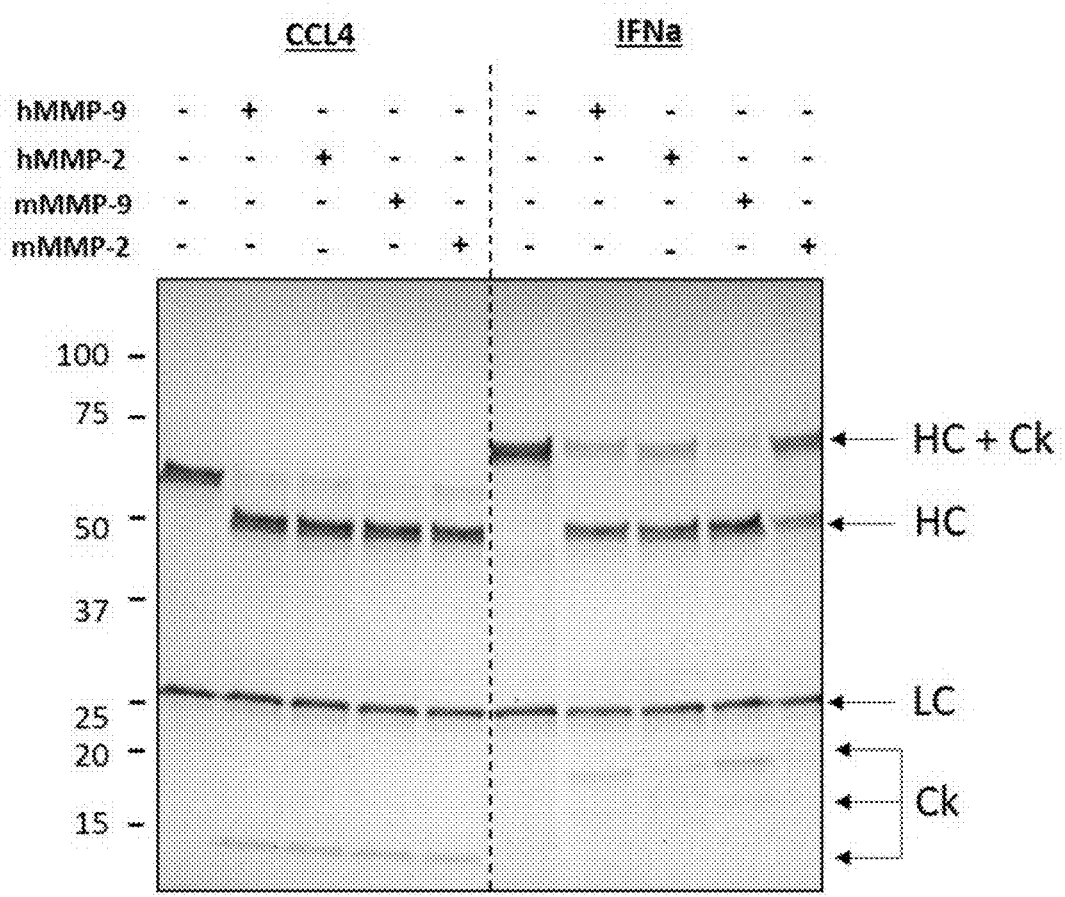

FIG. 6. Evaluation of cleavability of c9G4 based immunocytokines as well as H16/L16-IL-15 and HHS76-IL-15 immunocytokines by human and murine MMP-9 and MMP-2 (HC C-term fusion, linker PVGLIG (SEQ ID NO:44)). (A) c9G4-IL-15, H16/L16-IL-15, and HHS76-IL-15; (B) c9G4-CCL4 and c9G4-IFNα. HC: Heavy Chain, LC: Light Chain, Ck: Cytokine. The NanoLuc® fusion was used as positive control for cleavage efficiency. Note 1: IL-15 and IFNα visualisation post-cleavage in impaired by the high level of glycosylation of the proteins. Sample deglycosylation prior to cleavage allows visualisation of the released cytokines, indicating the proteins are not proteolysed by MMP-9/2 (data not shown). Note 3: The partial cleavage observed for the IL-15 fusion is likely due to the heterogeneity of the tested sample (≈50% monomer by Size-Exclusion Chromatography, data not shown).

FIG. 7: Summary of the MMP-9/2 linkers cleavability evaluation.

Figure 8:
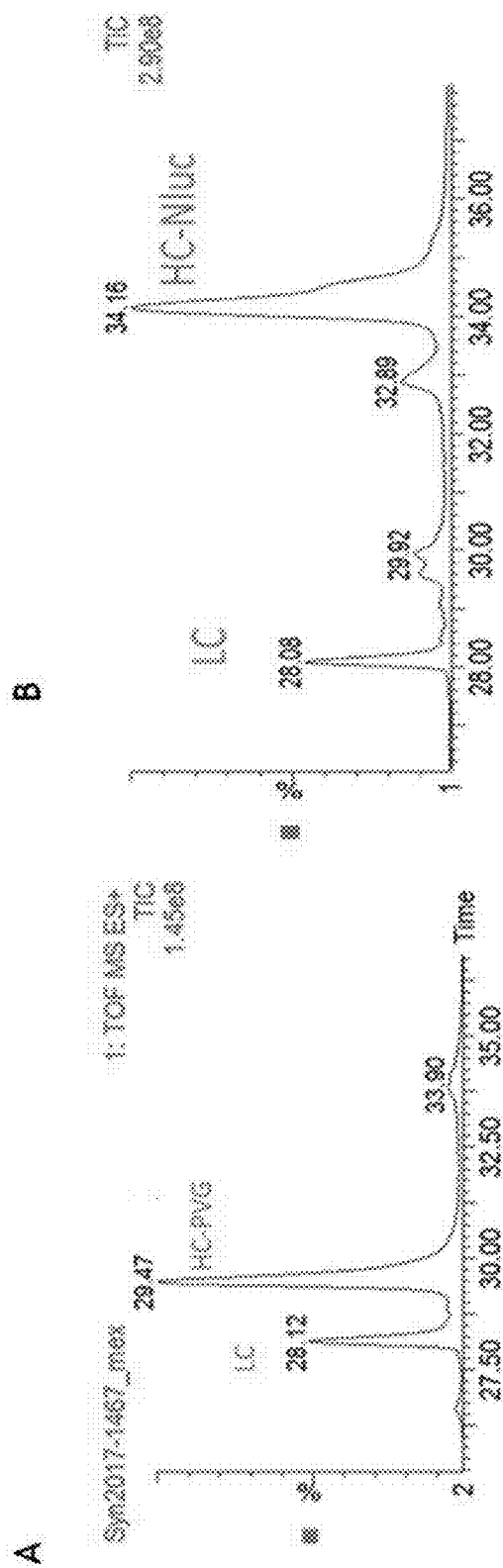

FIG. 8: PVGLIG (SEQ ID NO: 44) and GIVGPL (SEQ ID NO: 46) linker stability in presence of MMP-9 activity in 50 mM Tris pH7.5, 150 mM NaCl, 20 mM CaCl2) buffer: LC/MS fragment profile of anti-PDL1-PVGLIG-NanoLuc® (A) and anti-PDL1-GIVGPL-NanoLuc® (B) antibodies obtained after immunoprecipitation and reduction and reverse phase separation FIG. 9: Analysis of ICC cleavage in mouse serum: LC/MS profile of anti-PDL1-PVGLIG-NanoLuc® fragments obtained after immunoprecipitation, reduction and reverse phase separation at T0 (A) and T24 (B) without MMP-9 spiking, at T0 (C) and T24 (D) with MMP-9 spiking.

Figure 10:
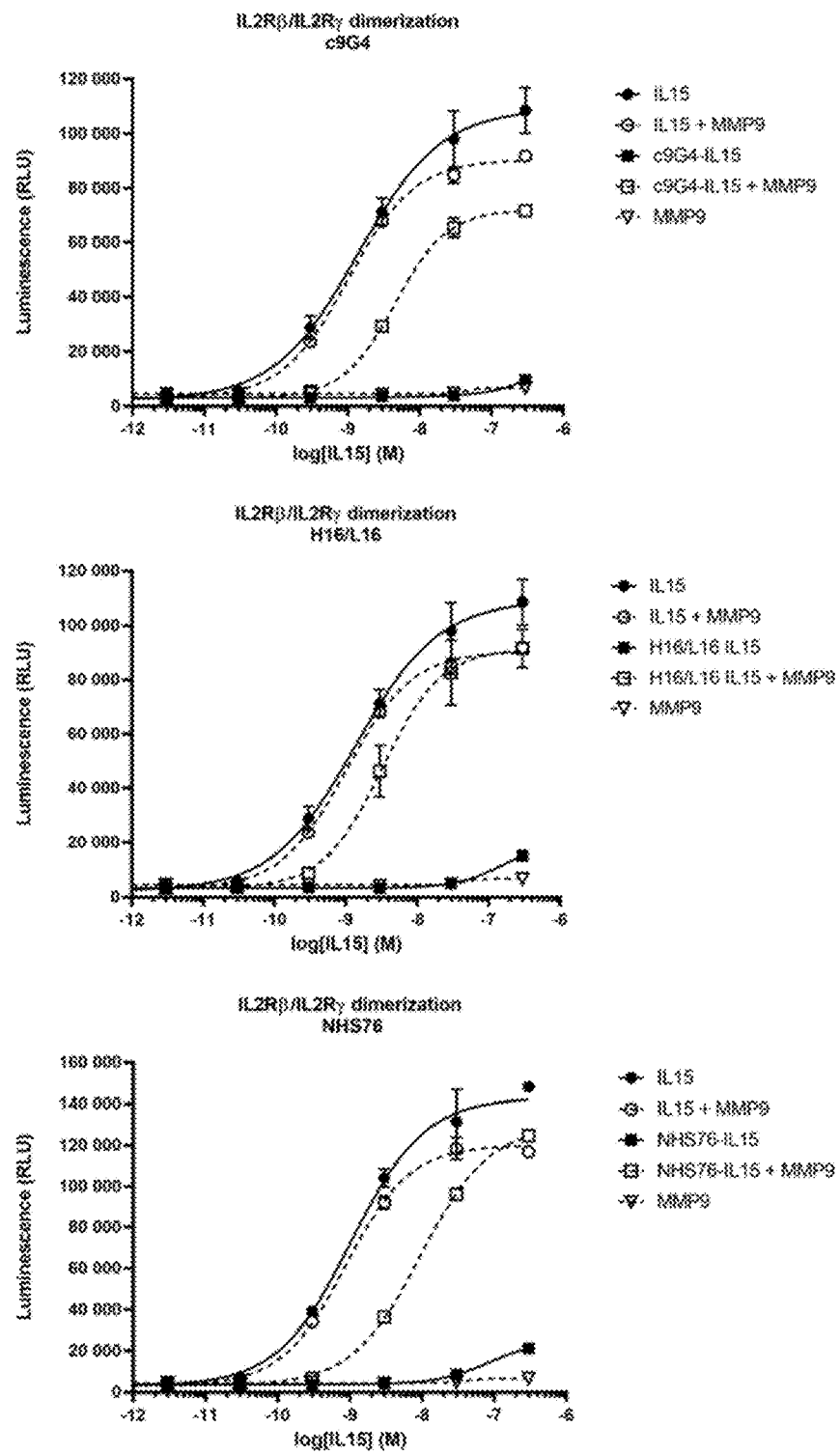

FIG. 10. IL-15 induced dimerisation of the IL-2Rβ and IL-2Rγ receptor subunits. Representative data from three independent experiments.

Figure 11:
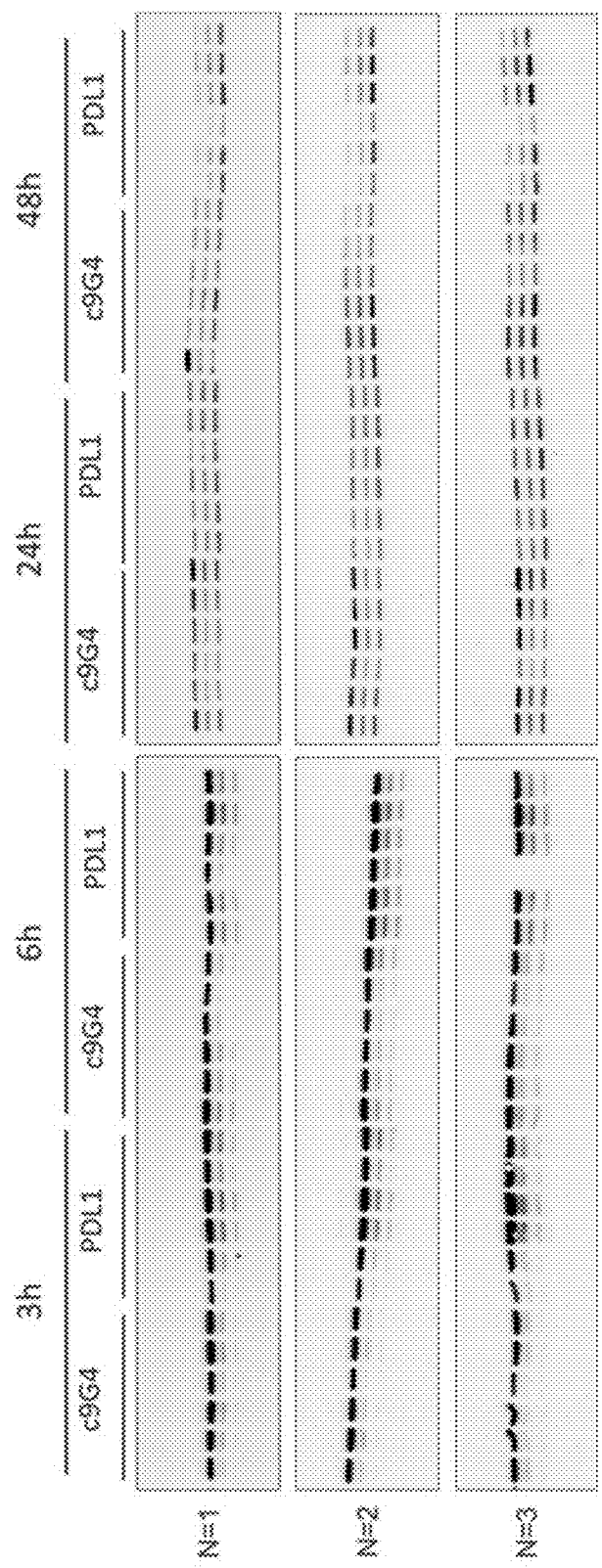

FIG. 11: Western blot analysis of plasma samples (RENCA engrafted mice).

Figure 12:
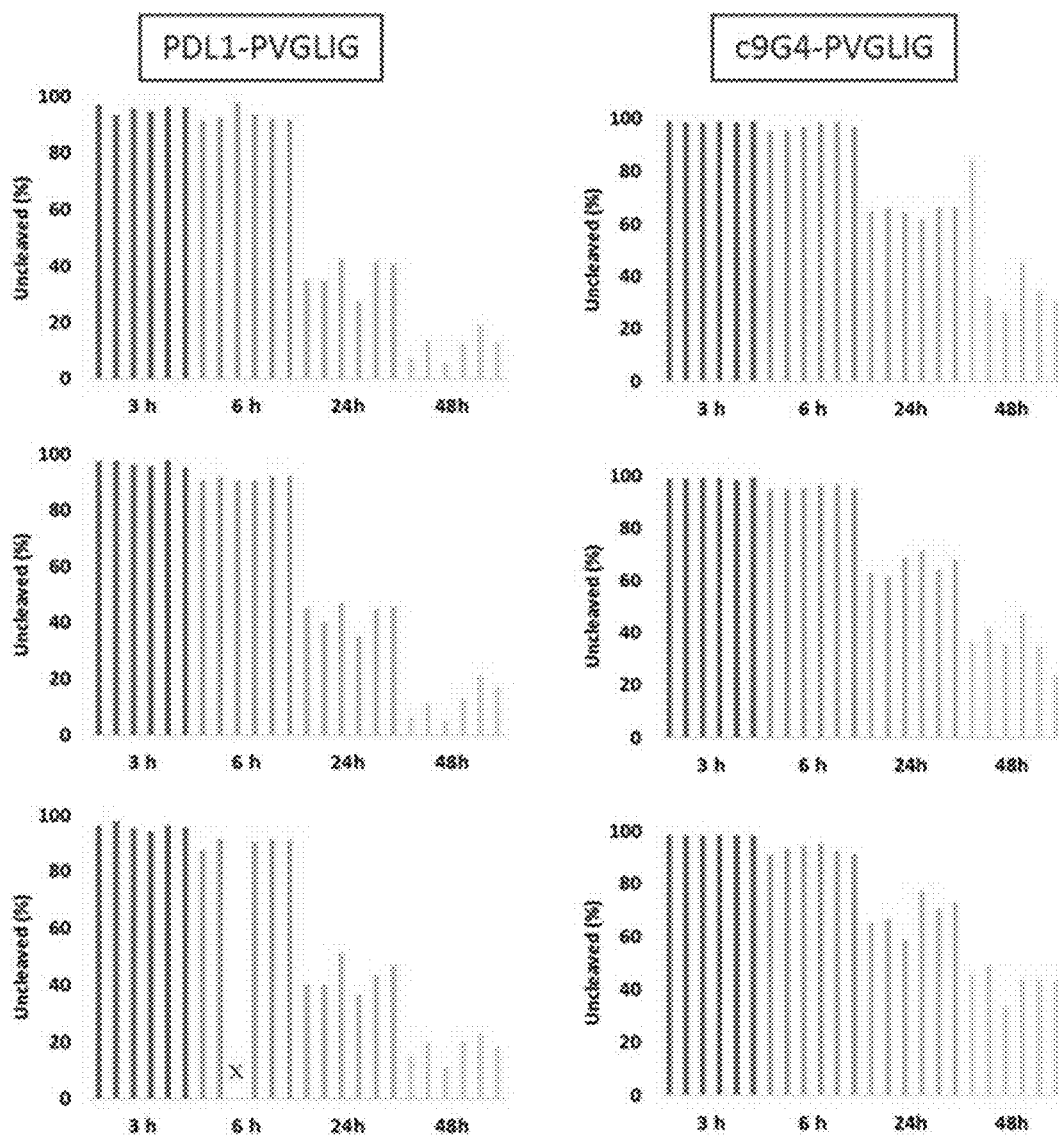

FIG. 12: Densitometric analysis of plasma samples western blots. X indicates that sample is missing.

Figure 13:
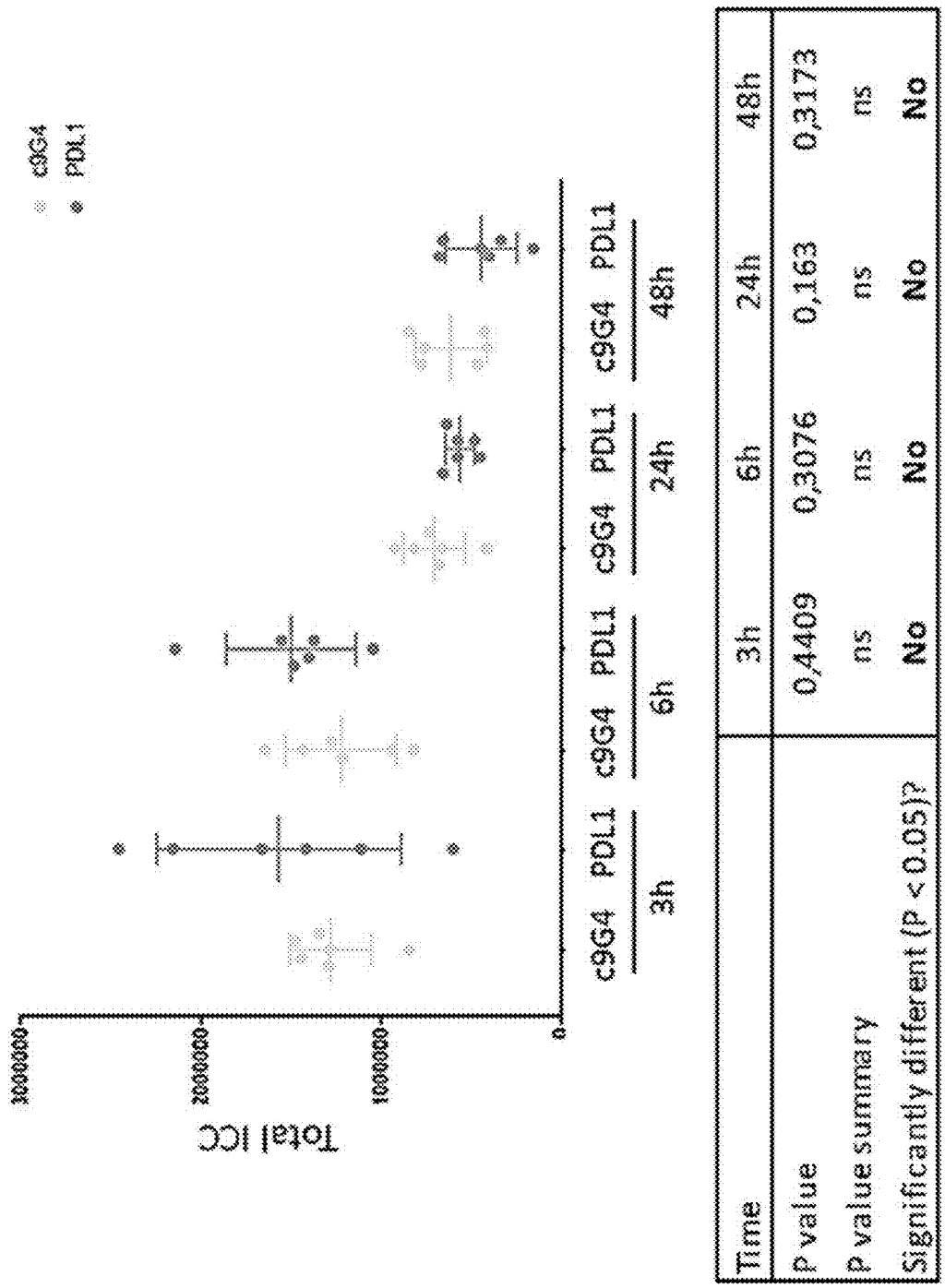

FIG. 13: Statistical analysis on circulating ICC (plasma samples) (RENCA engrafted mice)

Figure 14:
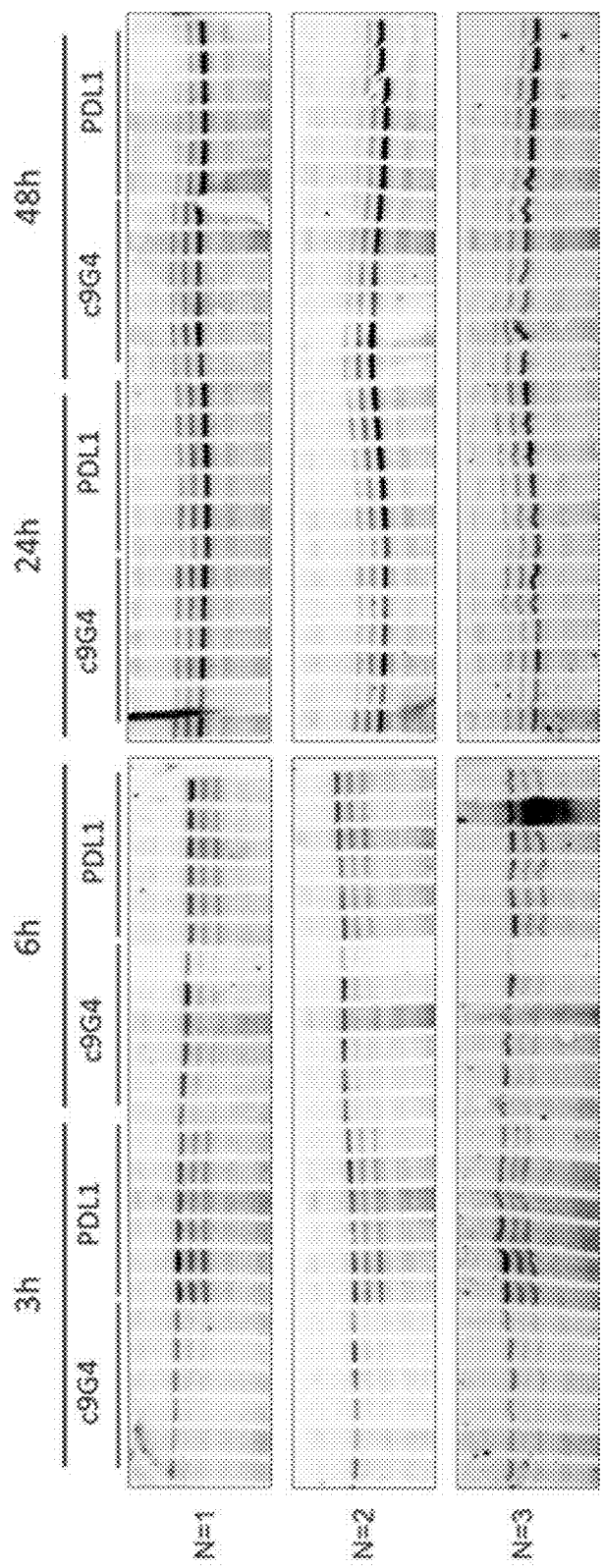

FIG. 14: Western blot analysis of tumour samples (RENCA engrafted mice).

Figure 15:
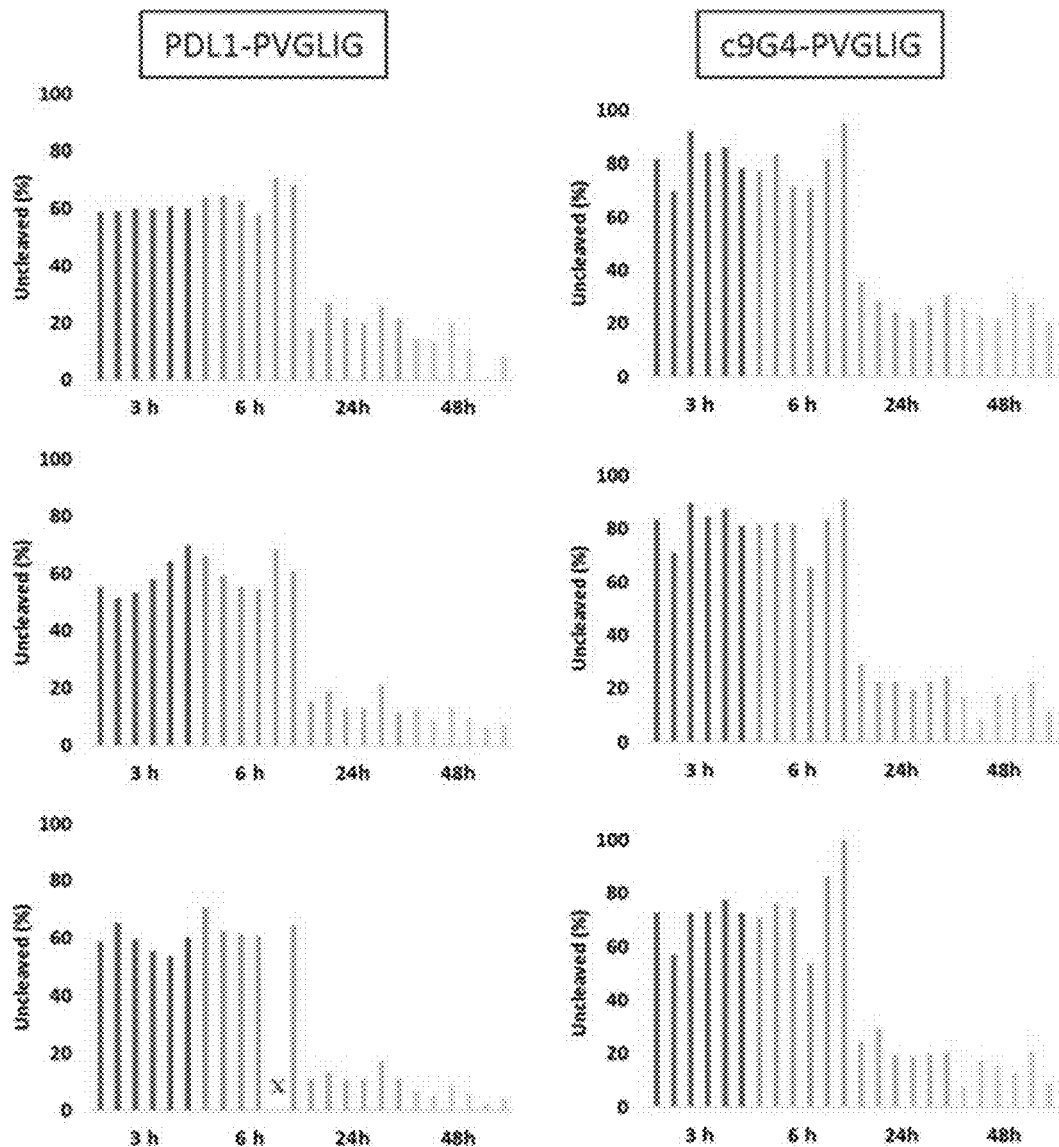

FIG. 15: Densitometric analysis of tumour samples western blots. X indicates that sample is missing.

Figure 16:
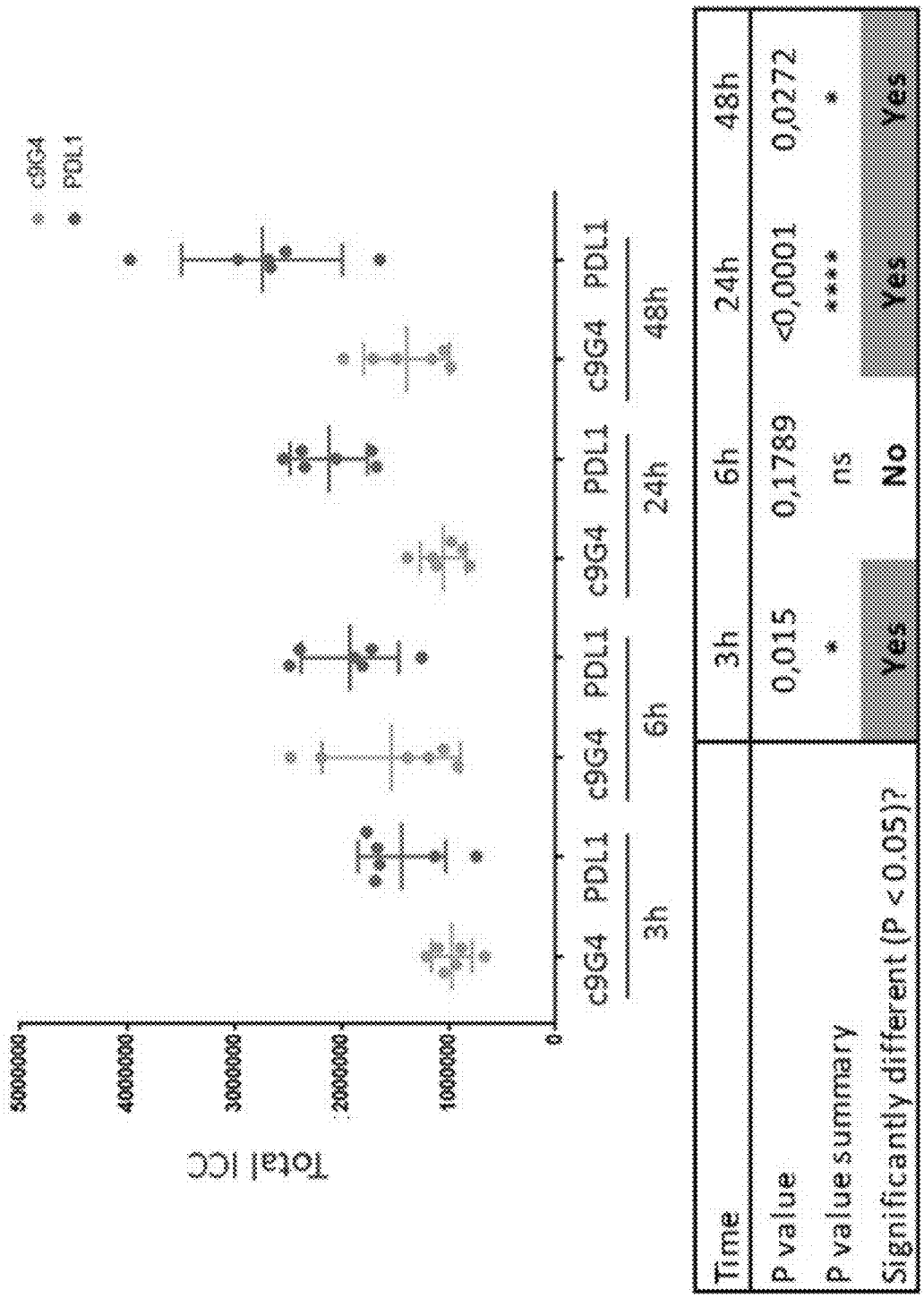

FIG. 16: Statistical analysis of ICC addressed to the RENCA tumours.

Figure 17:
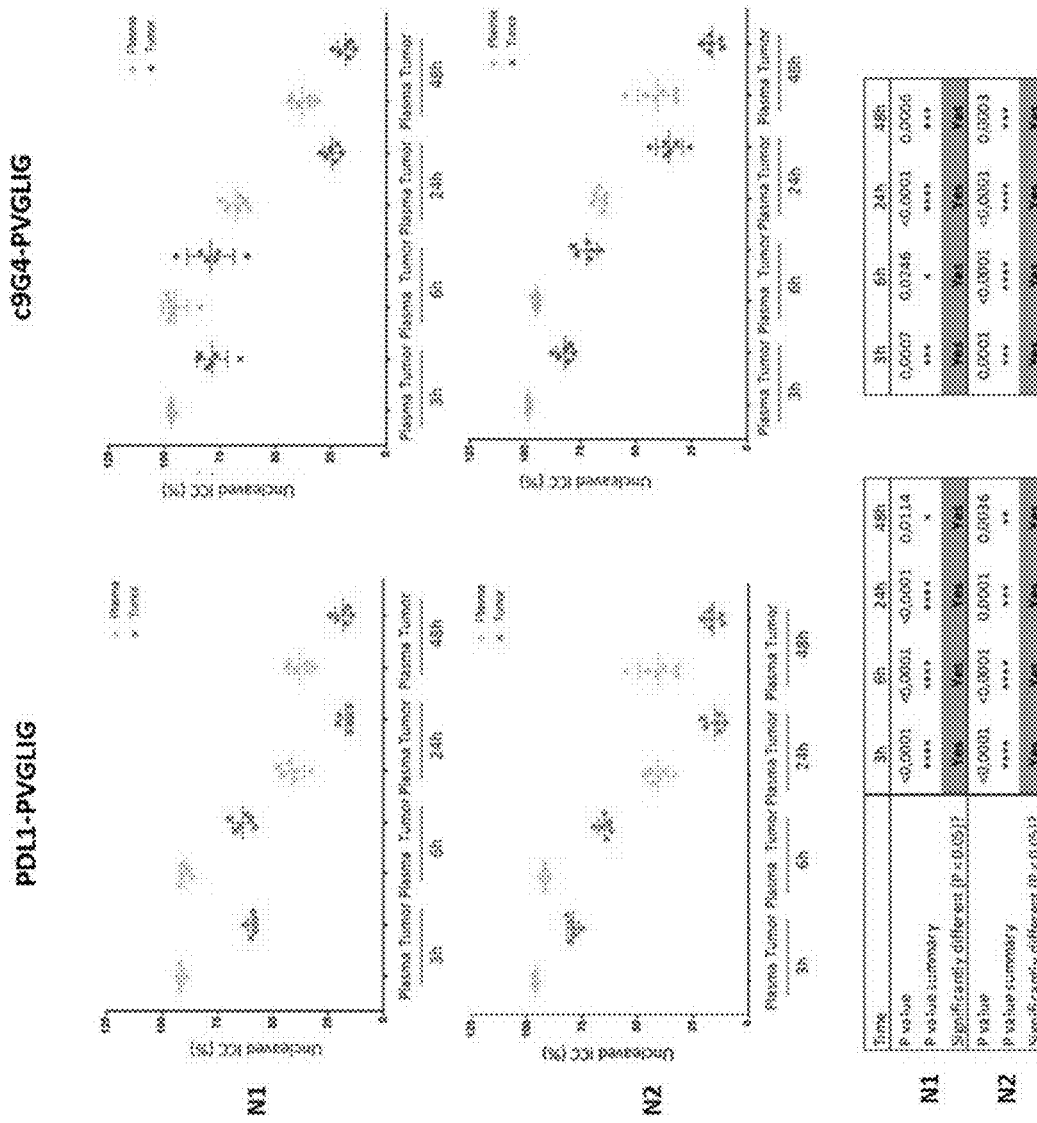

FIG. 17: Statistical analysis of ICC-PVGLIG behaviour in plasma versus tumour of RENCA engrafted mice.

Figure 18:
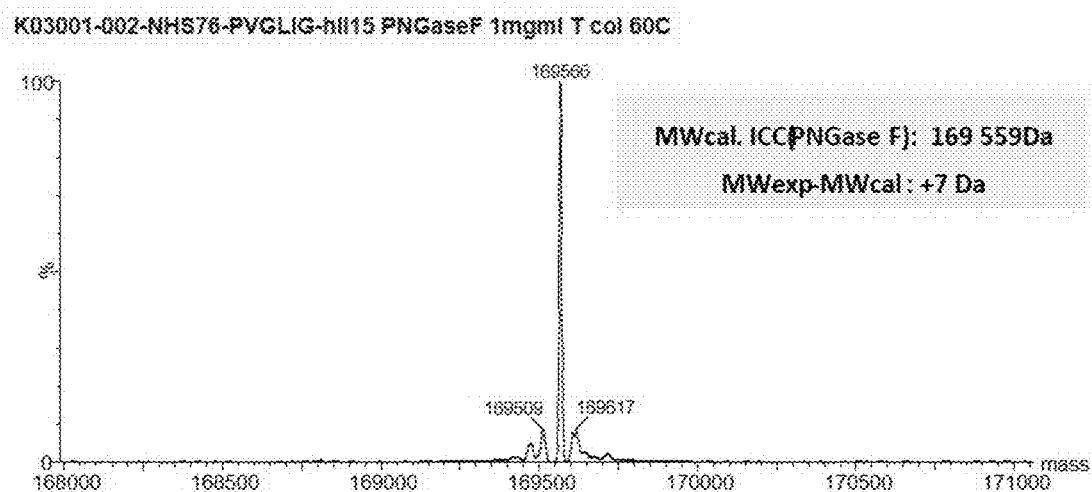

FIG. 18: Deconvoluted MS spectrum of NHS67-PVGLIG-IL-15 obtained after deglycosylation RP-LC separation.

Figure 19:
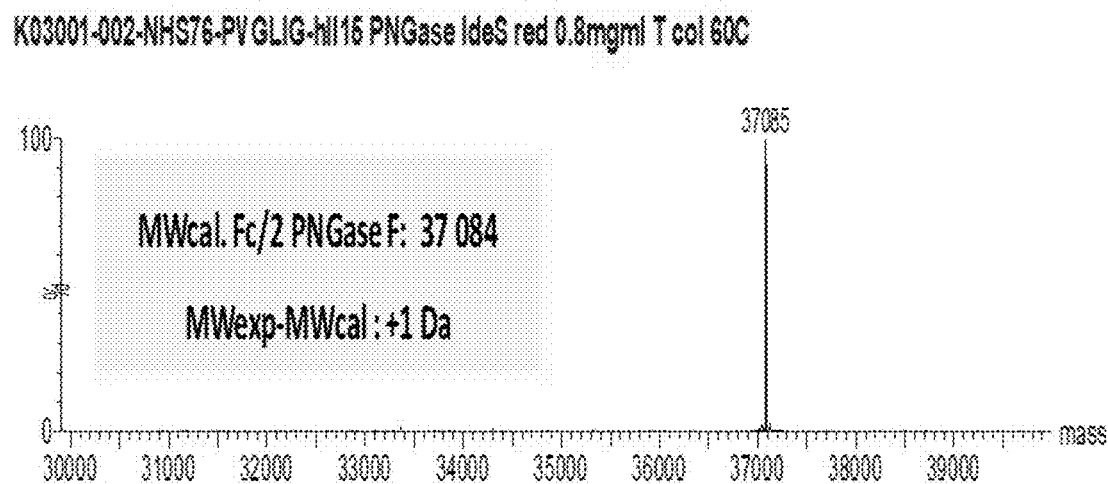

FIG. 19: Deconvoluted MS spectrum of Fcl2 NHS67-PVGLIG-IL-15 obtained after deglycosylation, IdEs digestion and RP-LC separation.

Figure 20:
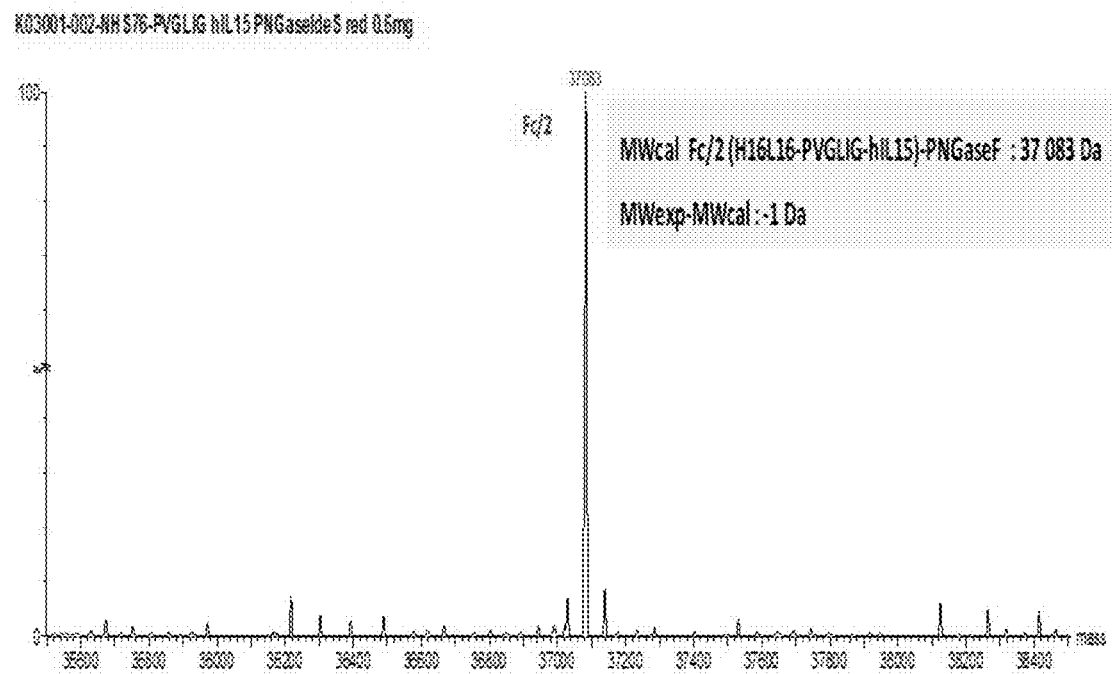

FIG. 20: Deconvoluted MS spectrum of H16L16-PVGLIG-IL-15 obtained after deglycosylation RP-LC separation.

Figure 21:
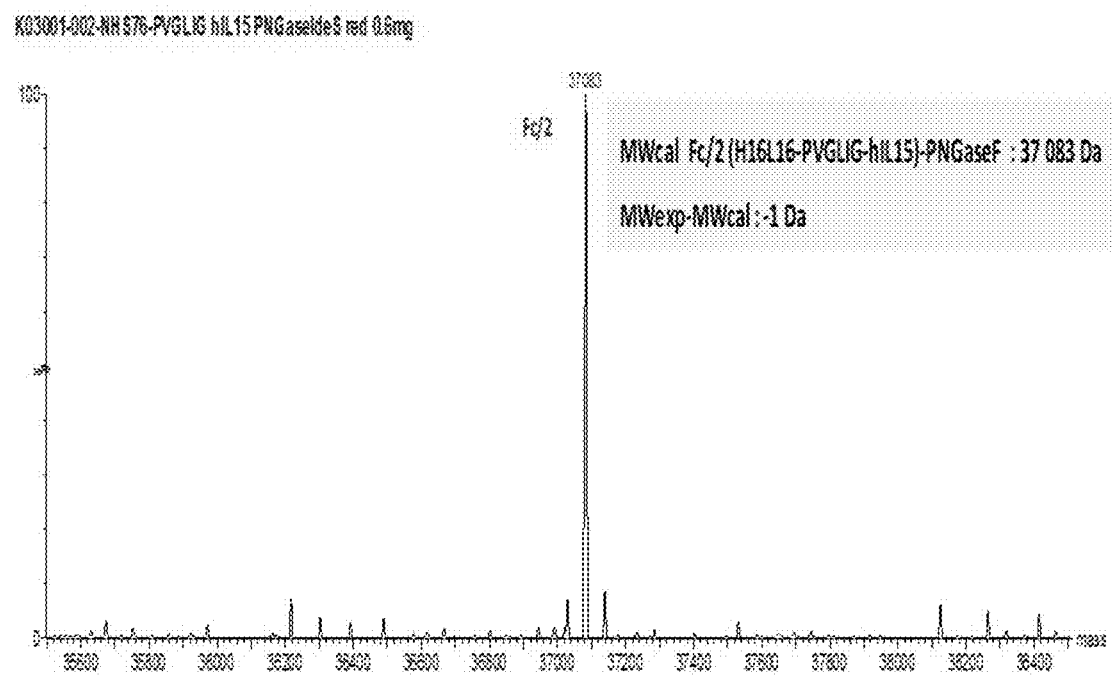

FIG. 21: Deconvoluted MS spectrum of Fcl2 H16L16-PVGLIG-IL-15 obtained after deglycosylation, IdEs digestion and RP-LC separation.

Figure 22:
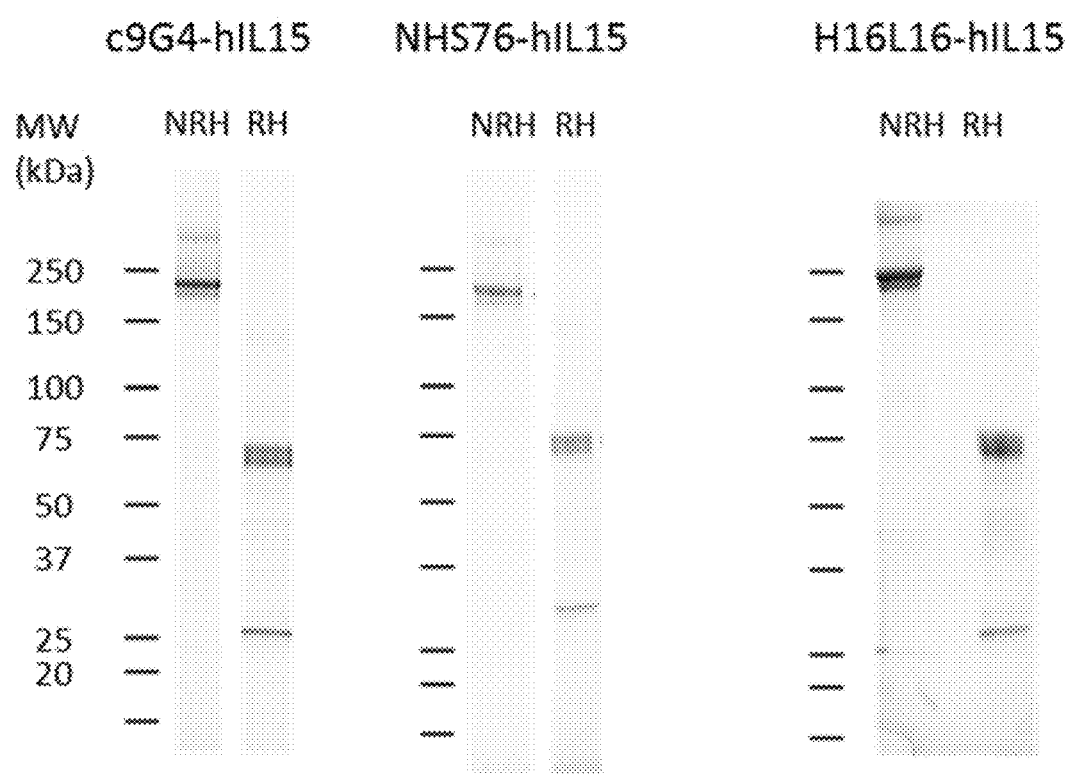

FIG. 22: SDS-PAGE analysis of purified c9G4-PVGLIG-hIL-15, NHS76-PVGLIG-hIL-15 and H16L16-PVGLIG-hIL-15 ICC in non-reduced/heated (NRH) and reduced/heated (RH) conditions.

FIGS. 23A-23D: Murine T cell activation with ICC compared to controls. Activation measured by T cells expression of CD69 (A) or CD25 (B) in presence of cleaved and uncleaved NHS76-PVGLIG-IL-15 or controls and by T cell expression of CD69 (C) or CD25 (D) in presence of cleaved and uncleaved H16L16-PVGLIG-IL-15 or controls.

FIGS. 24A-24D: Human T cell activation with ICC compared to controls. Activation measured by T cells expression of CD69 (A) or CD25 (B) in presence of cleaved and uncleaved NHS76-PVGLIG-IL-15 or controls and by T cell expression of CD69 (C) or CD25 (D) in presence of cleaved and uncleaved H16L16-PVGLIG-IL-15 or controls.

FIGS. 25A-25D: Human T cell activation with ICC compared to controls. Activation measured by T cells secretion of INFγ in presence of cleaved and uncleaved NHS76-PVGLIG-IL-15 or controls for two different donors (Donor 1 (A) and Donor 2 (B)). Upper panel: activation measured by T cell secretion of INFγ in presence of cleaved and uncleaved H16L16-PVGLIG-IL-15 or controls for two different donors (Donor 1 (C) and Donor 2 (D)).

Figure 26:
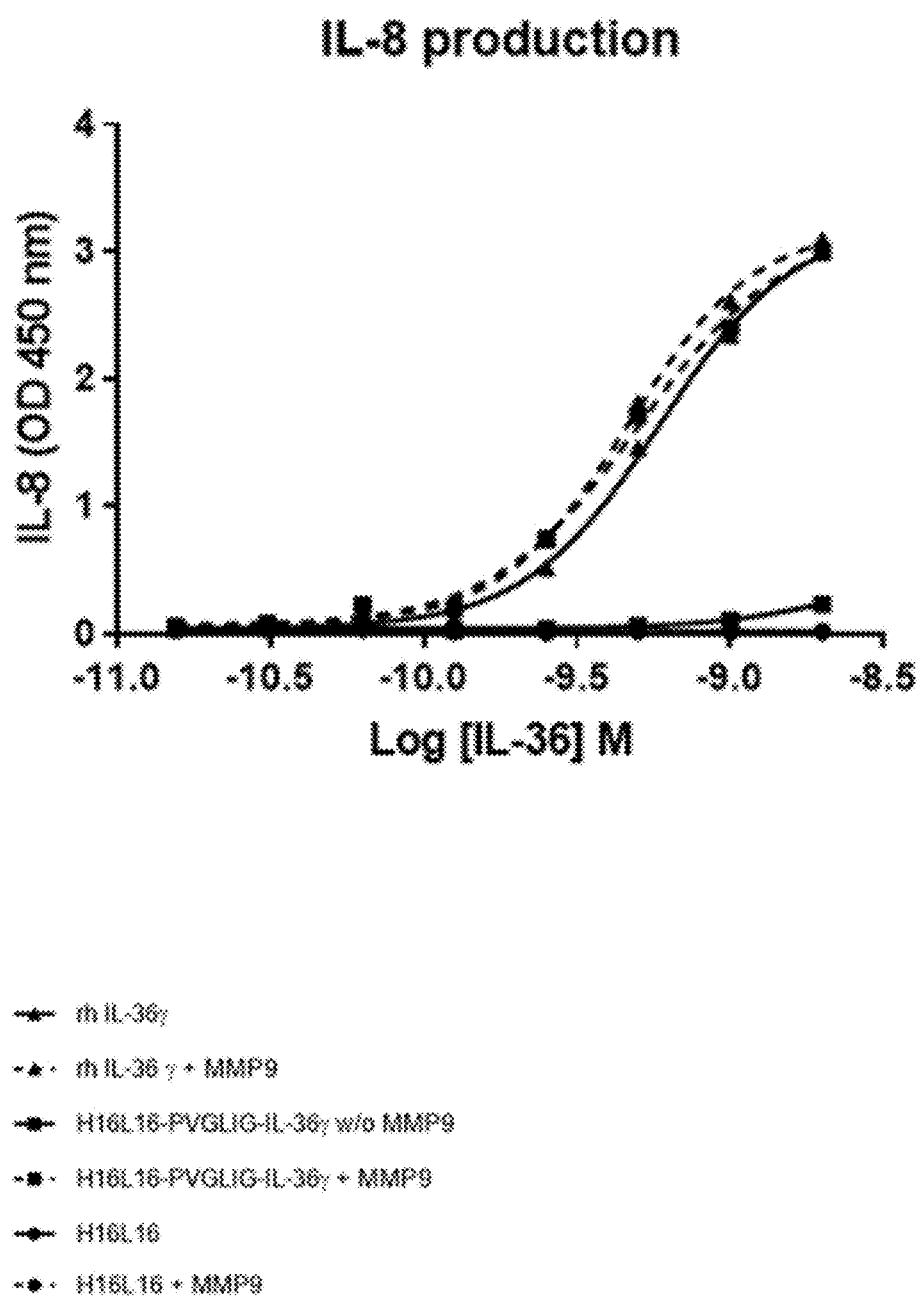
Figure 27A:
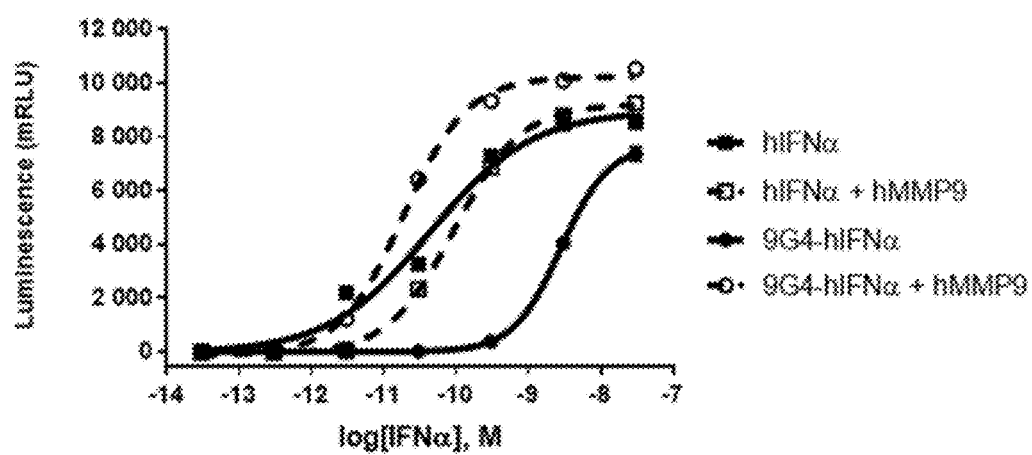
Figure 27B:
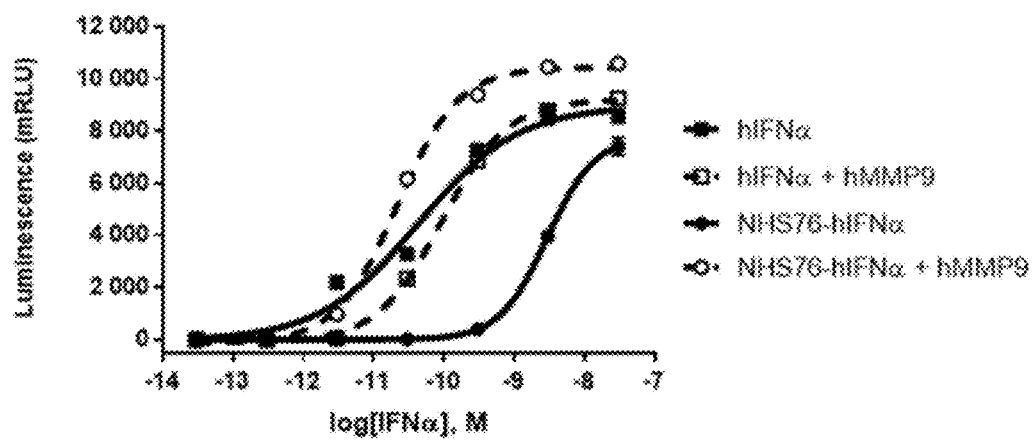
Figure 27C:
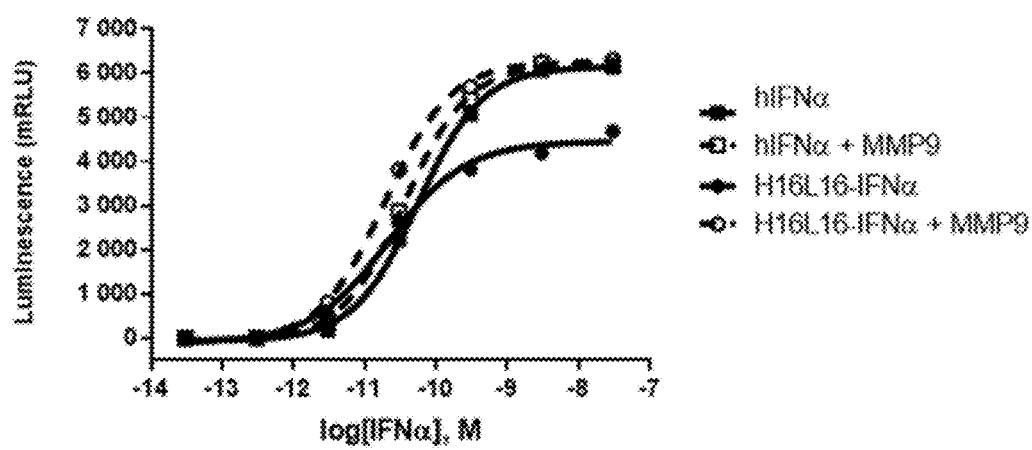
Figure 27D:
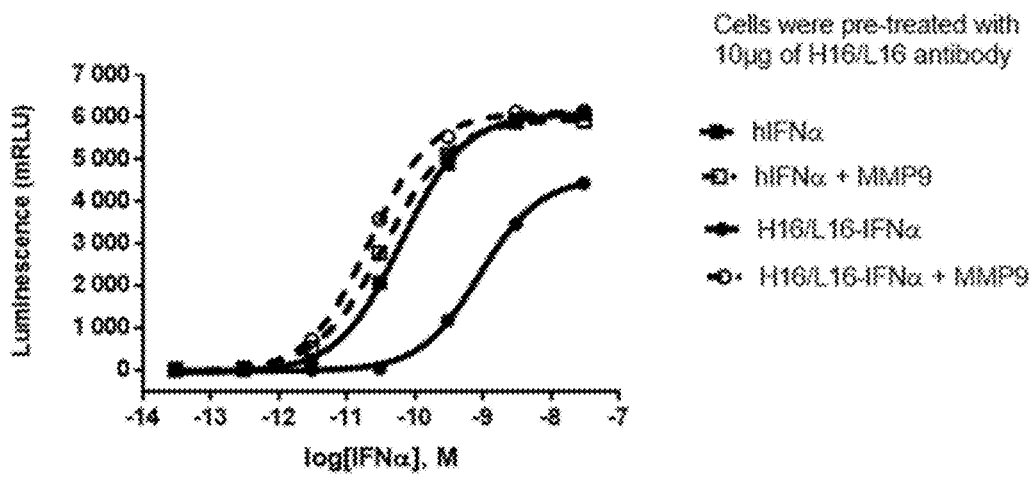

FIG. 26: Analysis of IL-8 production levels in A431 conditioned culture media after a 24 h incubation with the different samples. IL-8 relative content is determined using DUOSET ELISA and is expressed in optical unit at 450 nm.

FIGS. 27A-27D: Induction of ISRE-dependent luciferase dependent production by hIFNa2a. hIFNa2a activity was assayed in c9G4-PVGLIG-hIFNa2a (A), NHS76-PVGLIG-hIFNa2a (B), and H16L16-PVGLIG-hIFNa2a, with (C) or without (D) preincubation of the cells with 10 µg/ml H16/L16 antibody, by monitoring luminescence produced in the GloResponse™ ISRE-luc2PIHEK293 (Promega).

Figure 28:
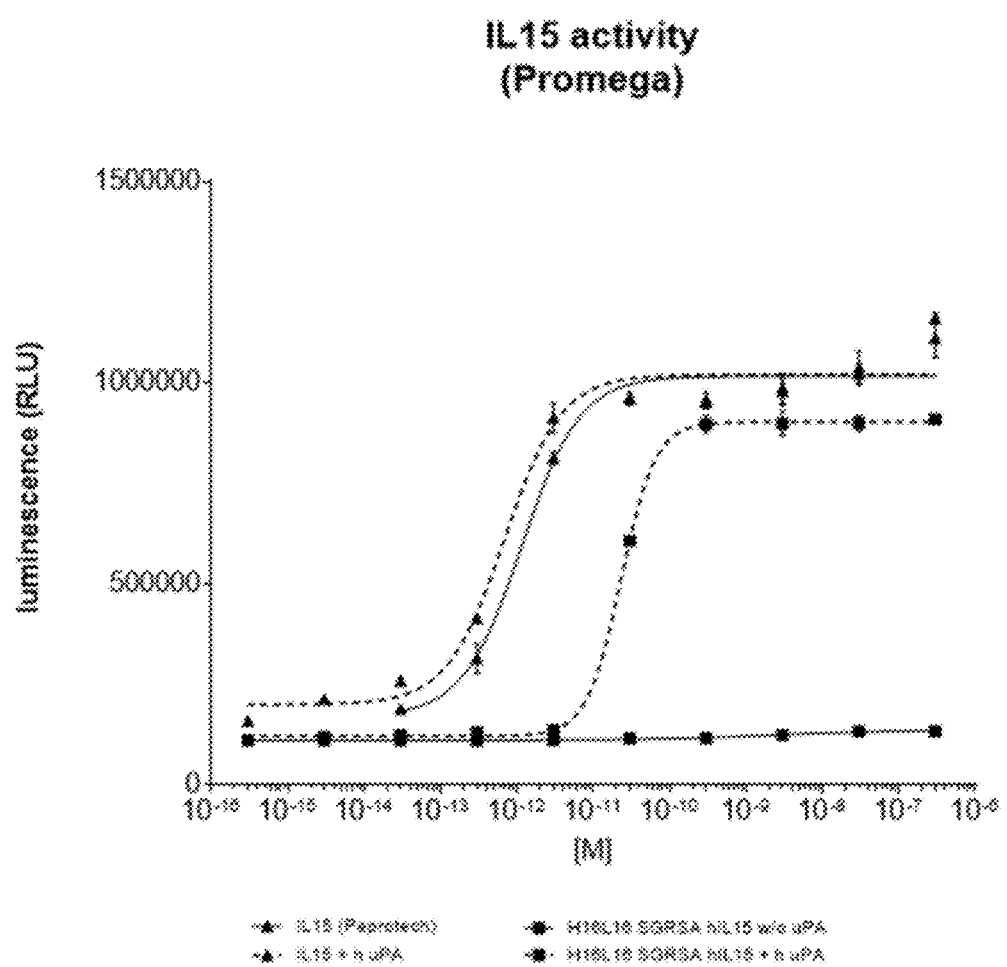

FIG. 28: IL-15 activity after a 6 h incubation with/without urokinase. IL-15 relative content is determined using IL-15 Bioassay and is expressed in luminescence.

Figure 29A:
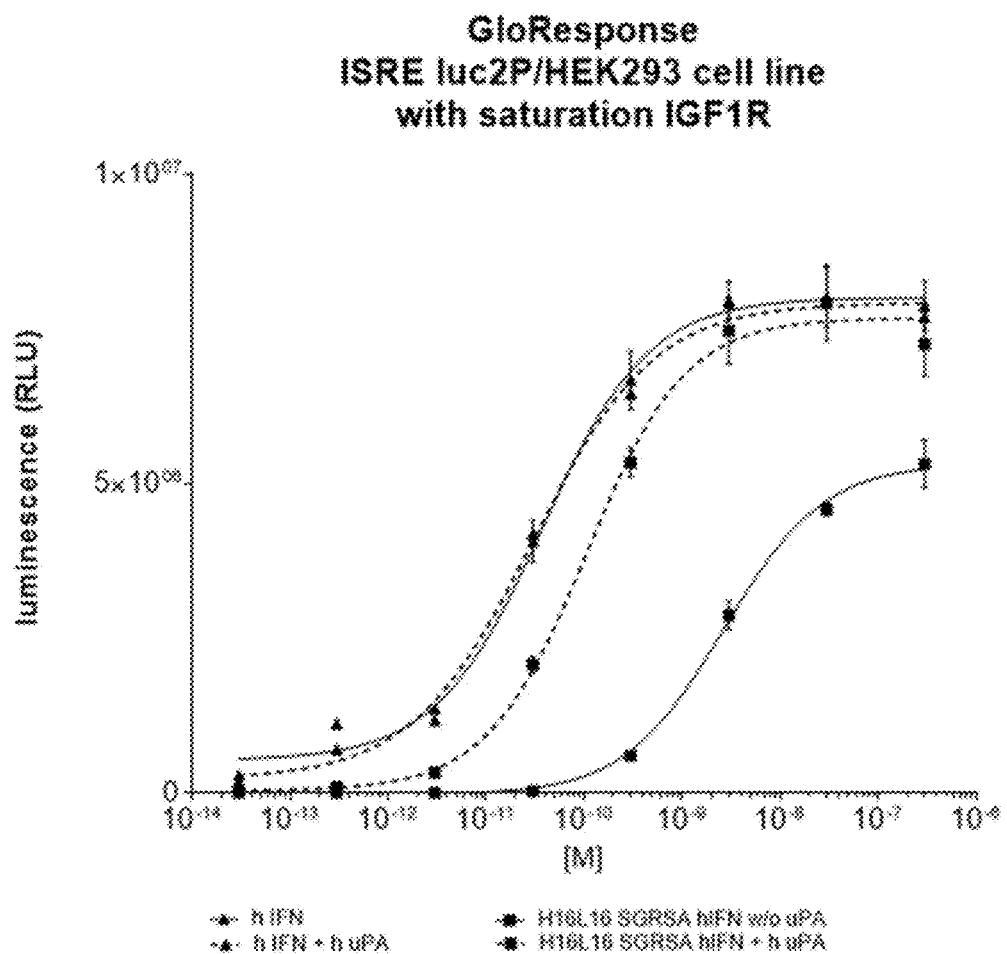
Figure 29B:
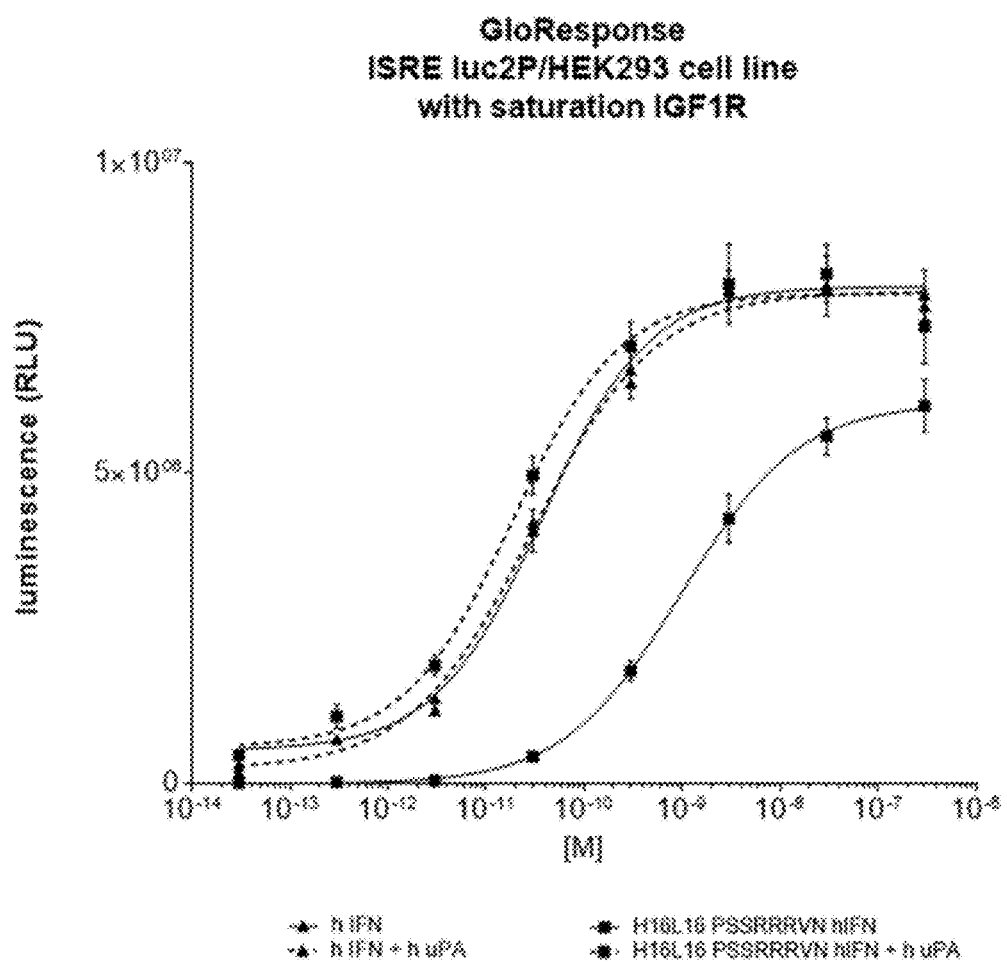

FIGS. 29A-29B: Evaluation of hIFNα activity after uPA-mediated cleavage of H16/L16-SGRSA hIFNa2a (A) and H16/L16-PSSRRRVN hIFNa2a (B). hIFNa activity was assayed after a 24 h-incubation of H16/L16-SGRSA hIFNa2a (A) and H16/L16-PSSRRRVN hIFNa2a (B) with/without urokinase and after IGF1R receptor saturation in ISRE-luc2/HEK293. Relative hIFNa activity is determined using GloResponse ISRE-luc2P Bioassay and is expressed in luminescence.

Figure 30A:
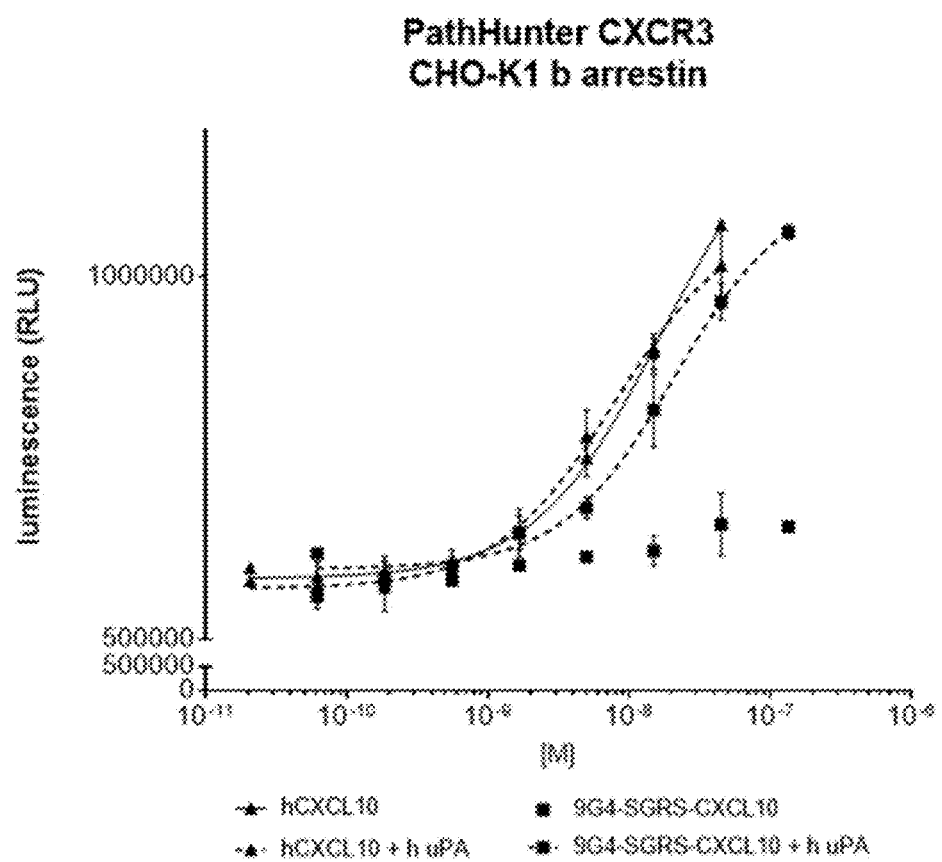
Figure 30B:
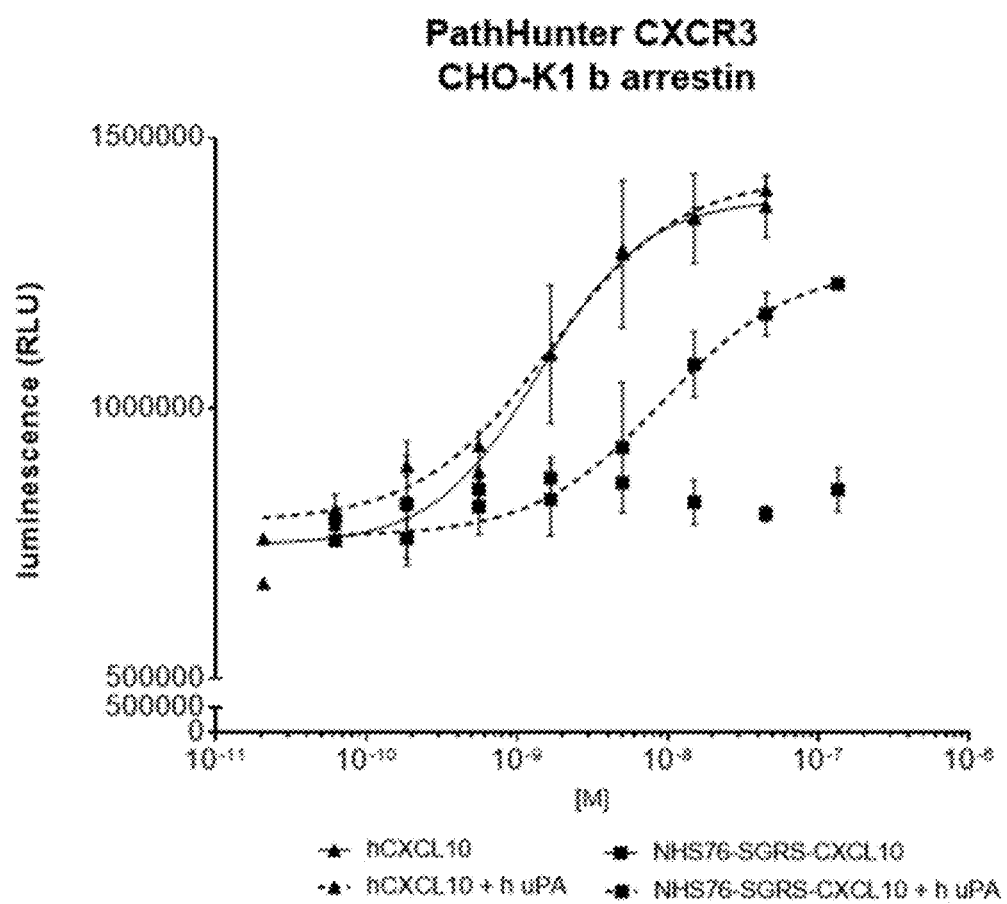
Figure 30C:
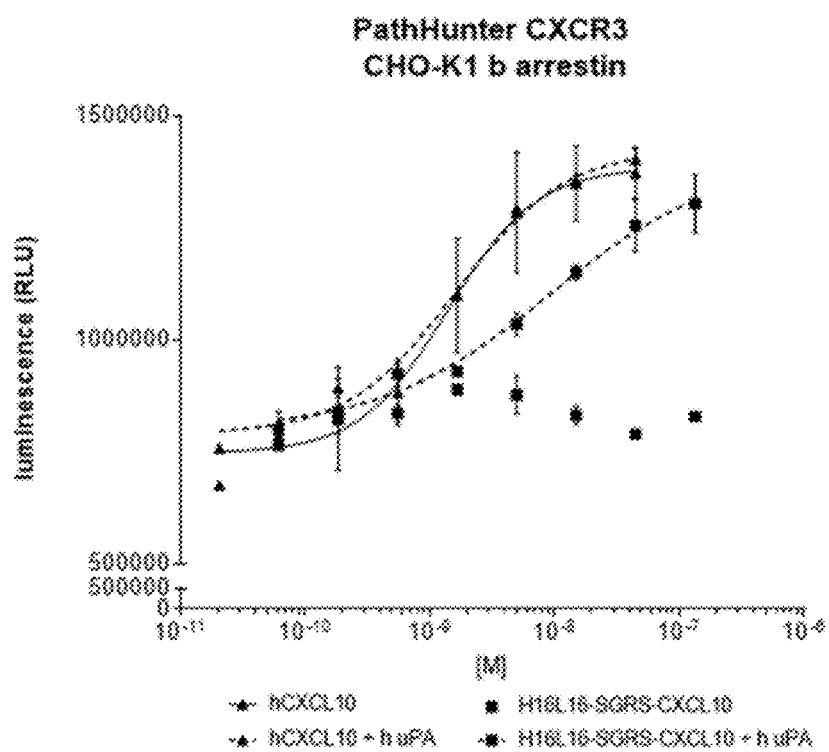

FIGS. 30A-30C: Evaluation of hCXCL10 activity after uPA-mediated cleavage of c9G4-GSRS-CXCL10 (A), NHS76-GSRS-CXCL10 (B), and H16/L16-SGRS-CXCL10 (C). Relative hCXCL10 activity is determined using PathHunter eXpress CXCR3 CHOK1 δ-arrestin GPCR assay and is expressed in luminescence.

Figure 31:
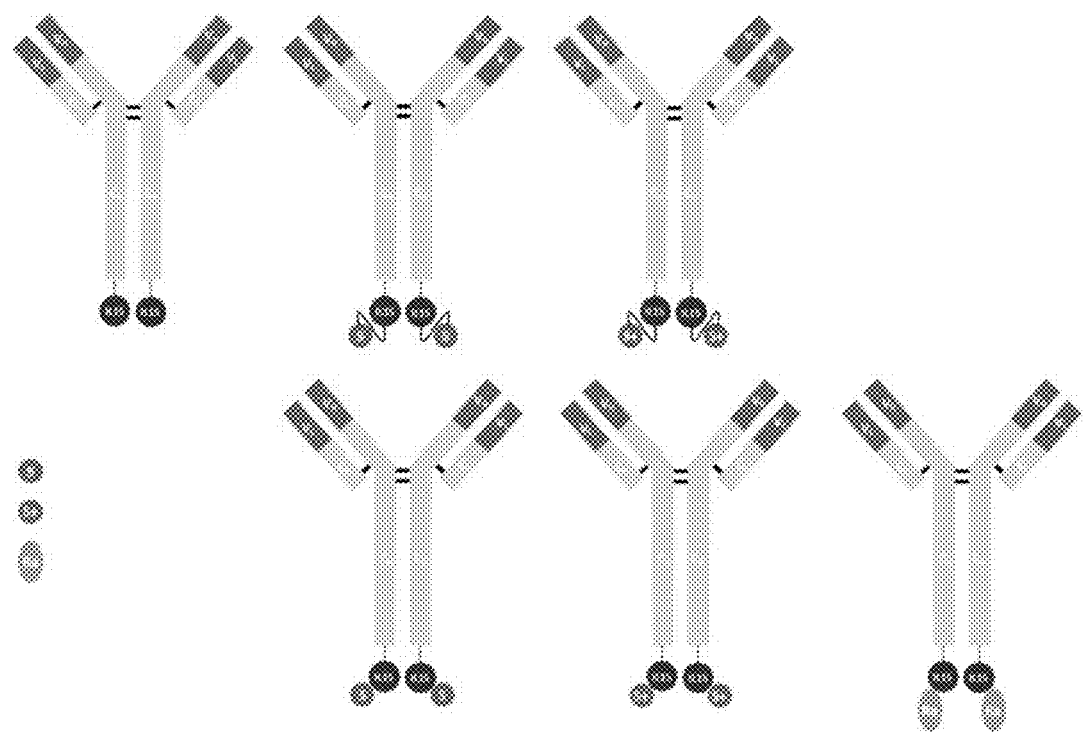

FIG. 31. Protein complexes used.

FIG. 32: List of the protein complexes used. For each molecule are indicated its code, its name, and each of its components. The mode of interaction (covalent or co-expression) between the cofactor and the immunocytokine is also mentioned.

Figure 33A:
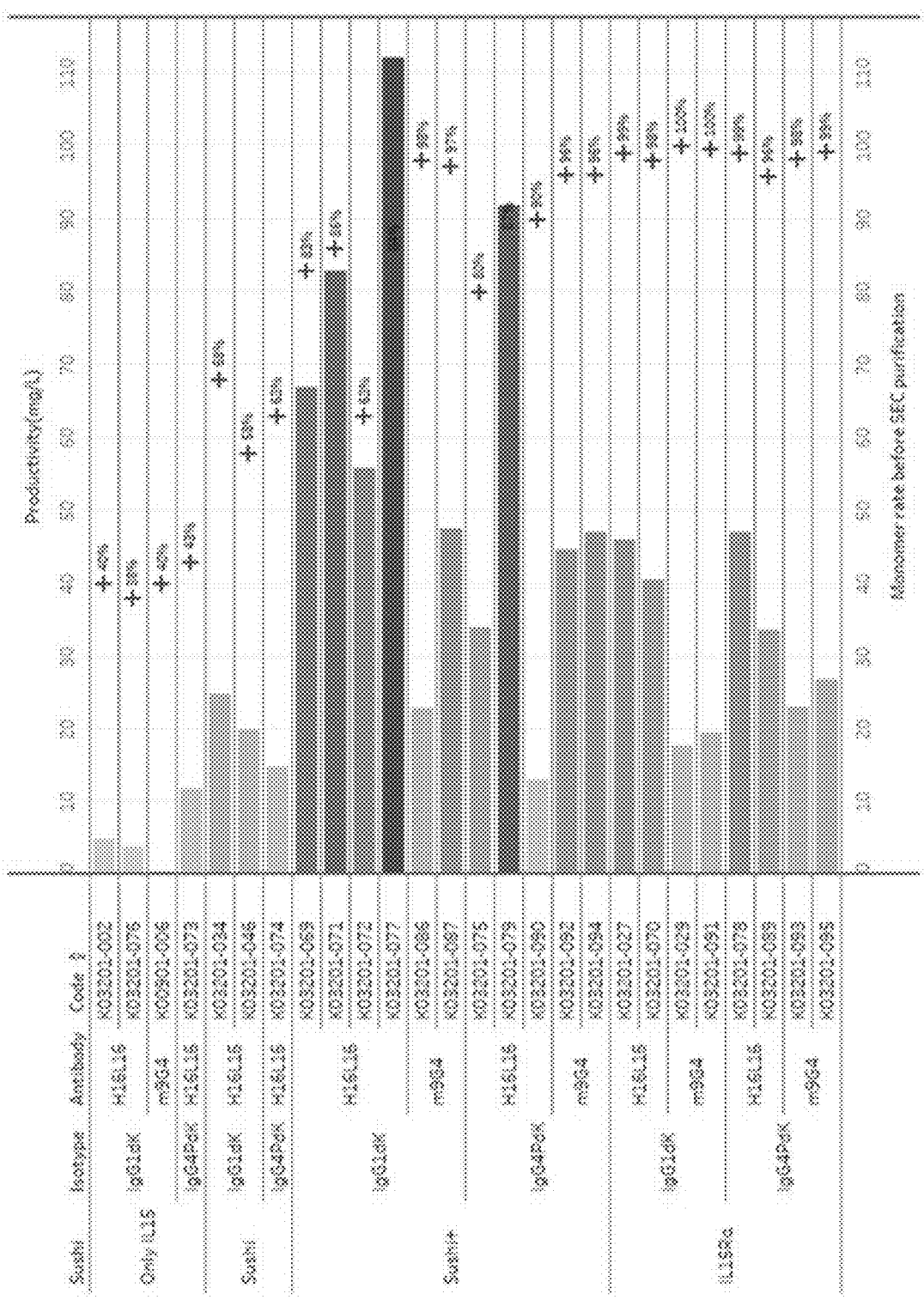
Figure 33B:
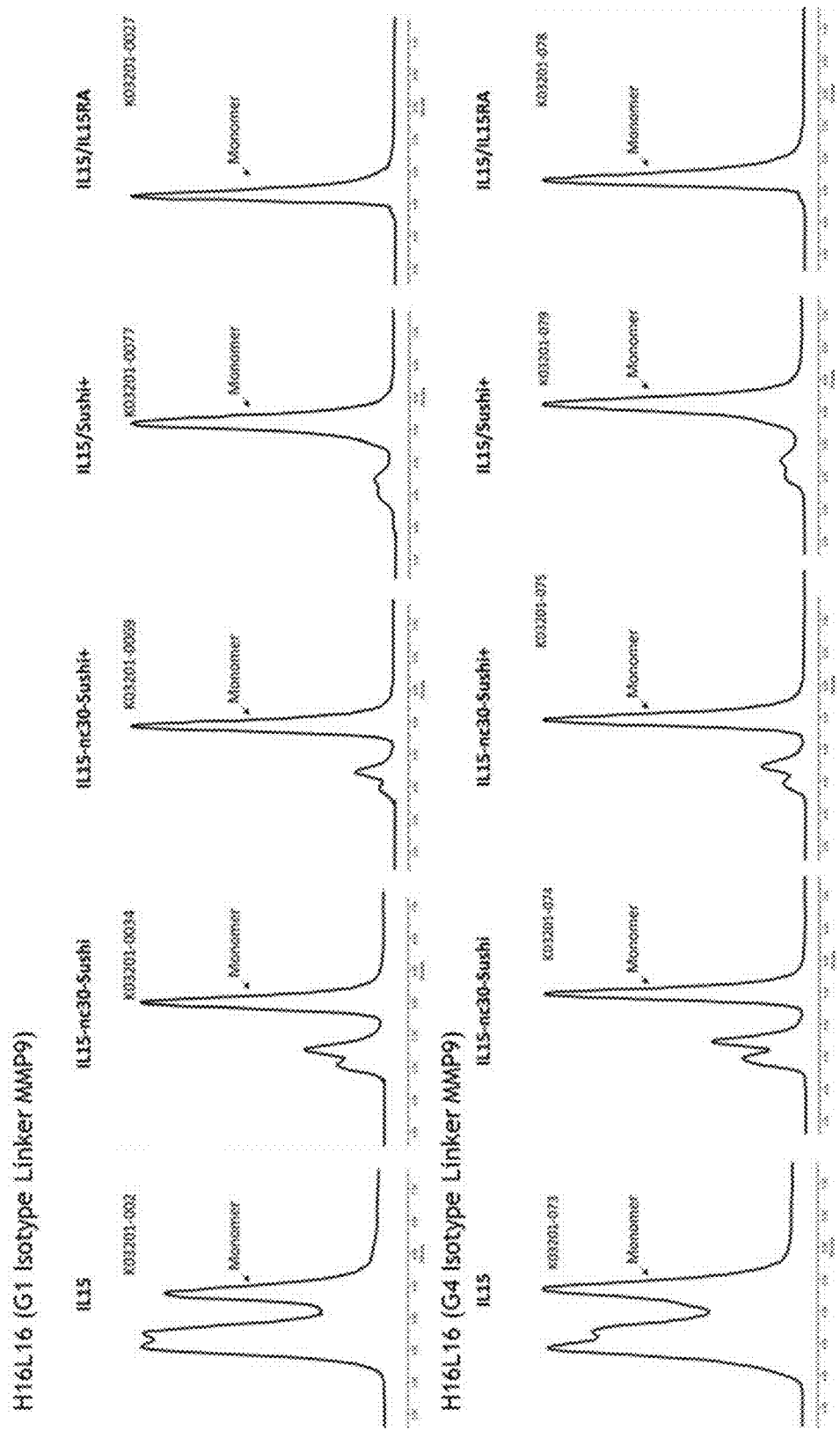
Figure 34A:
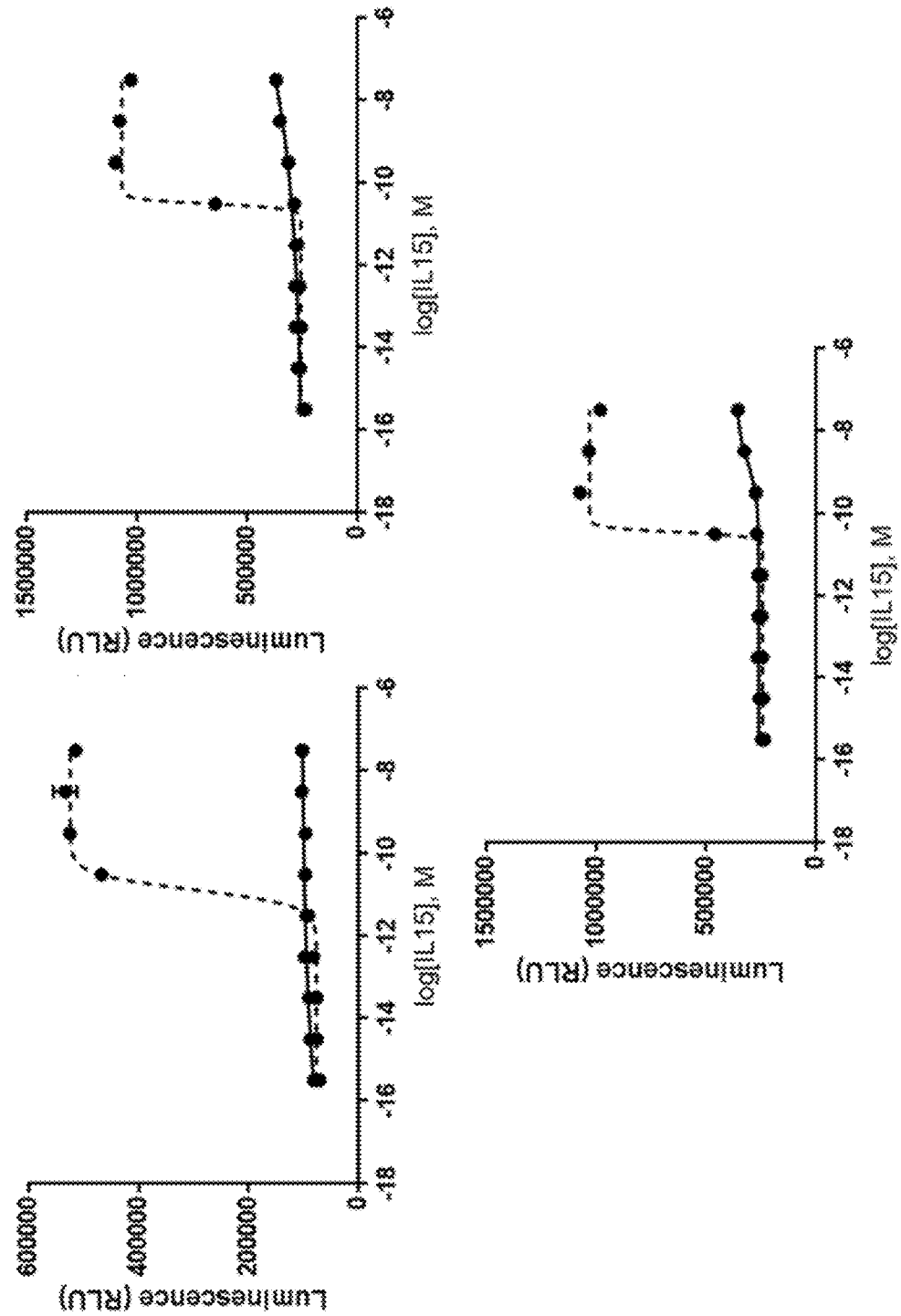
Figure 34B:
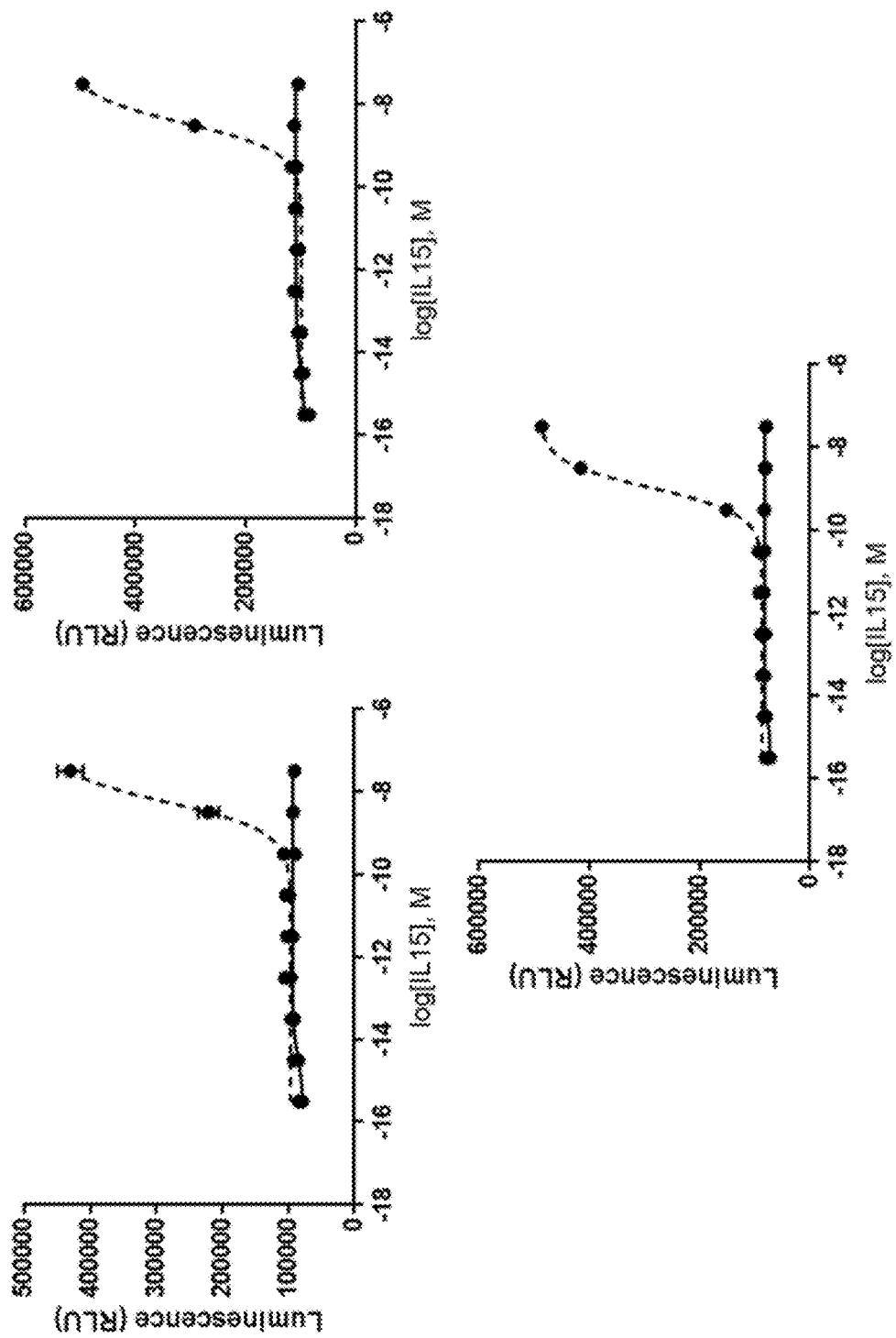
Figure 34C:
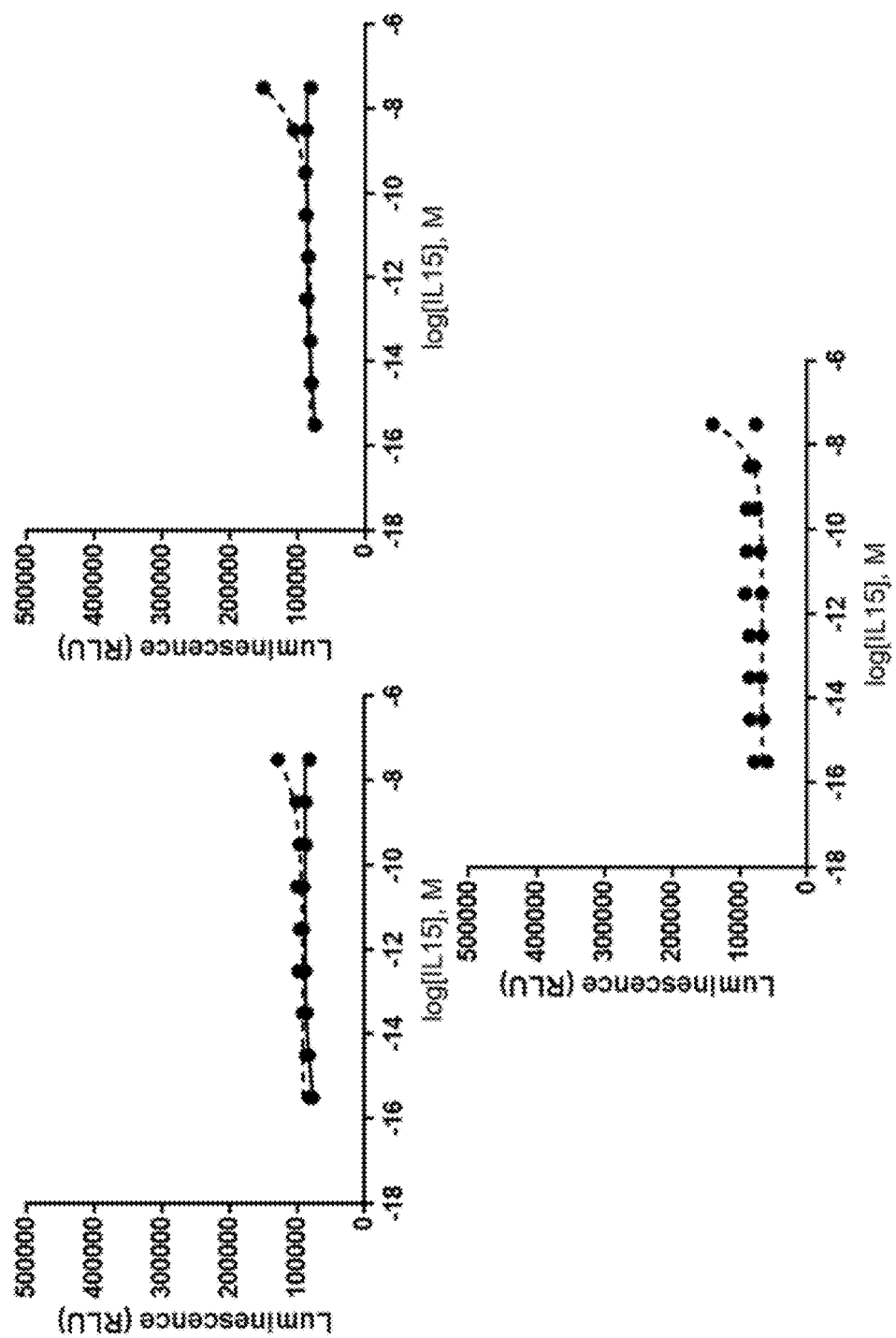
Figure 34D:
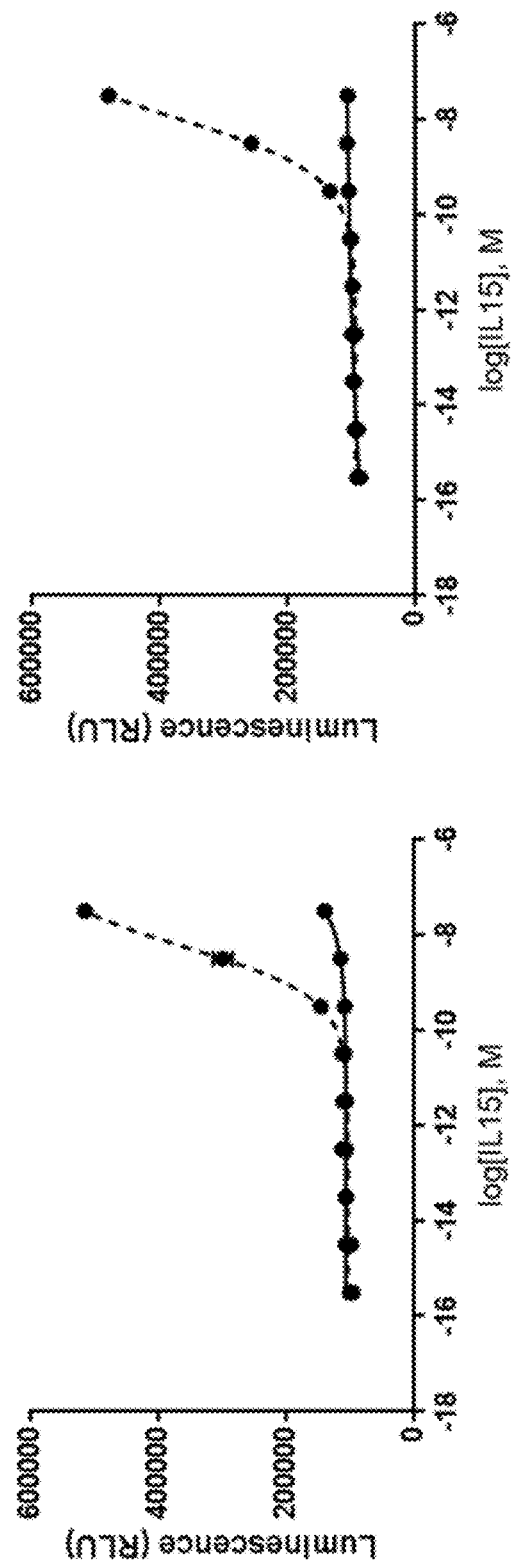
Figure 34E:
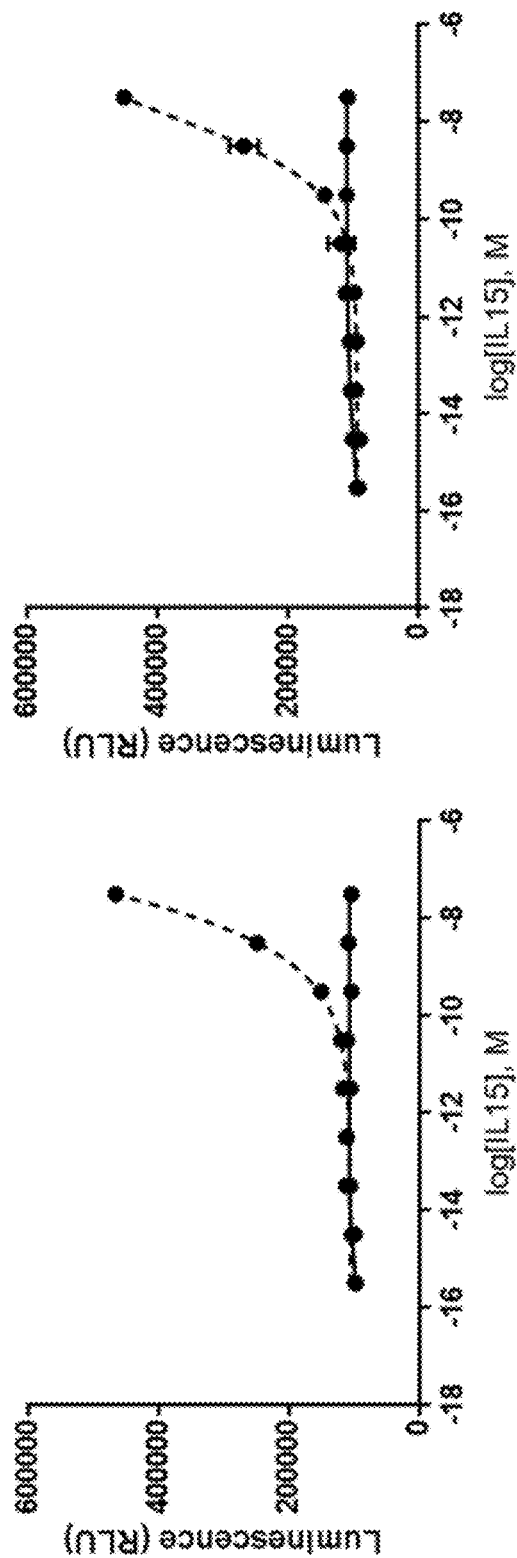
Figure 34F:
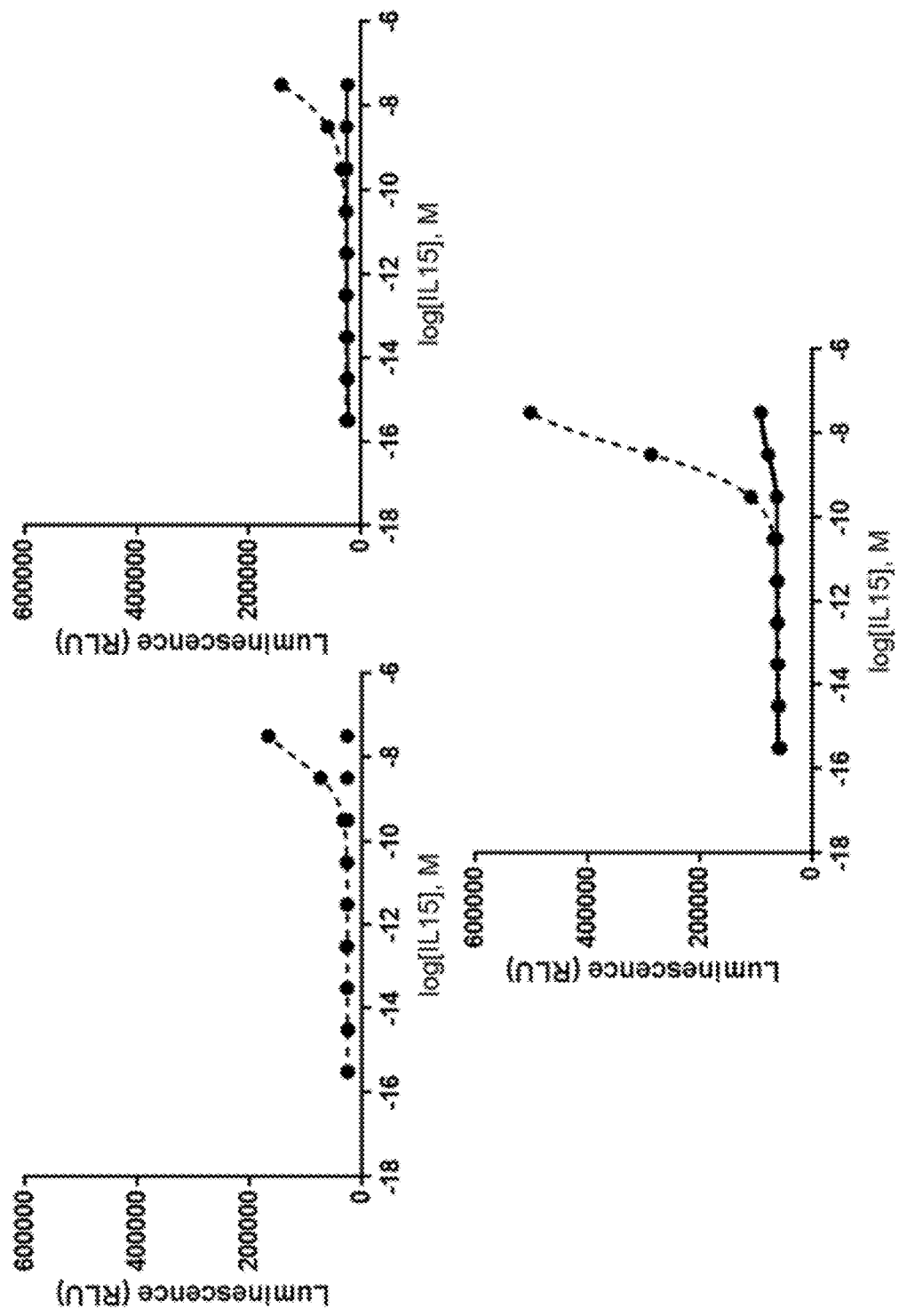
Figure 34G:
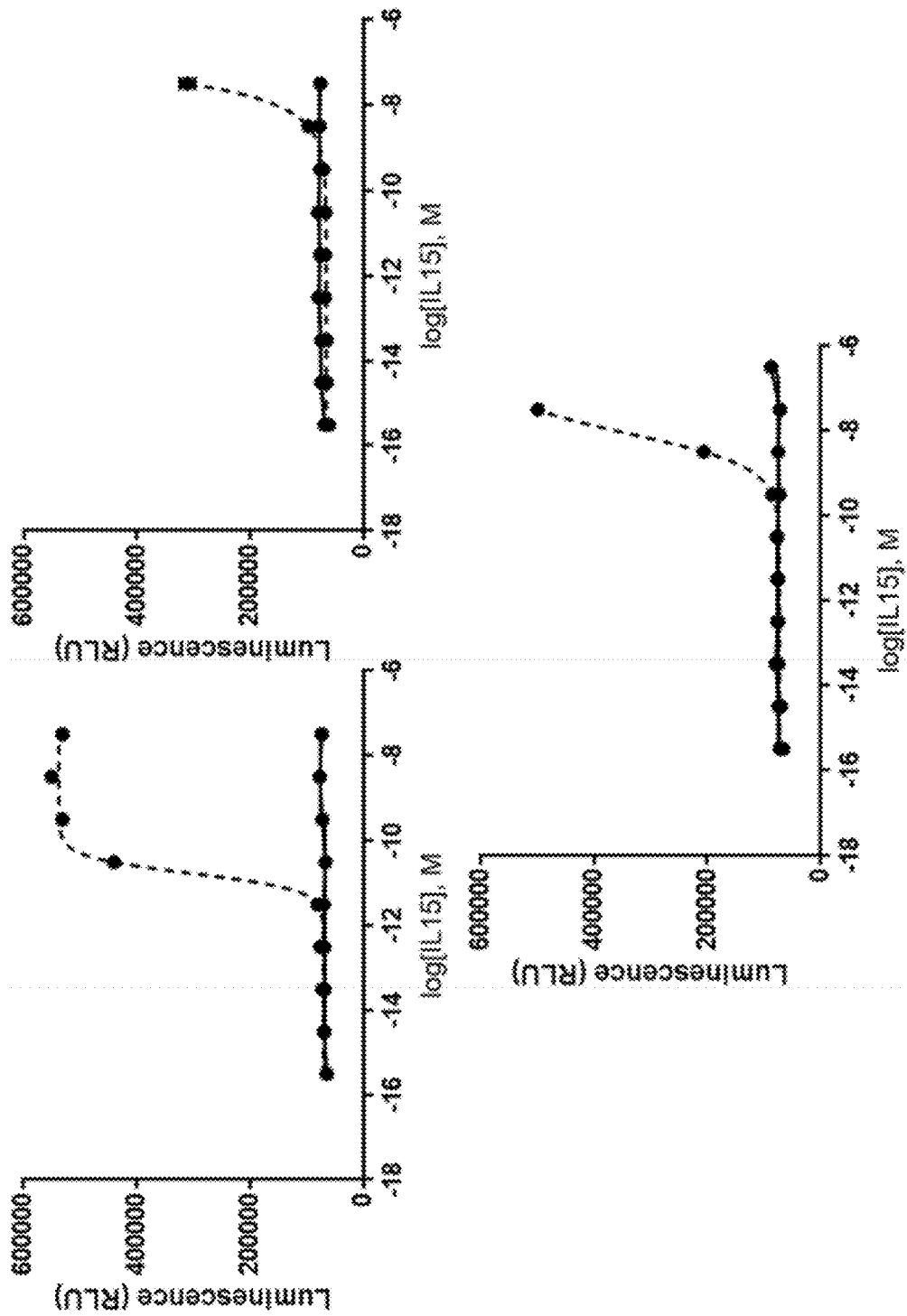
Figure 34H:
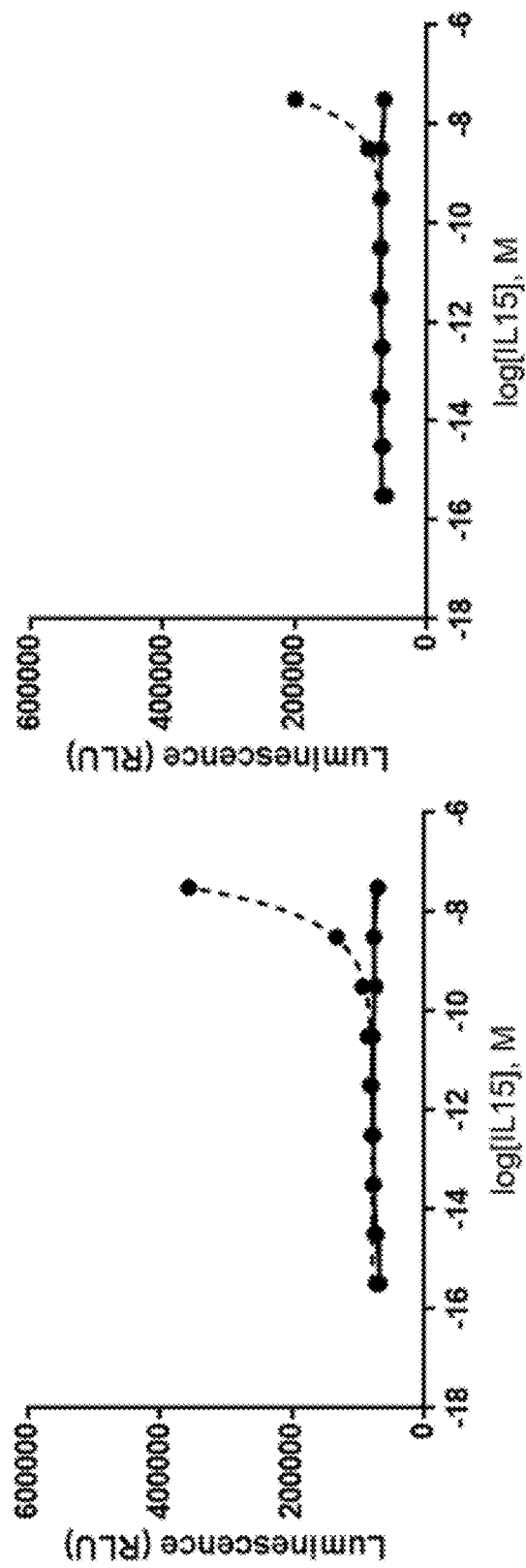

FIGS. 33A-33B: Productivity and monomer levels of the molecules produced in HEK293 cells. The bar chart represents productivity of the cells expressing the different molecules (colour scale from light to dark: low to high productivity). These molecules have been characterised by SEC analysis and the monomer rate of the molecule is reported on the graph (cross); the values obtained for K03201-077 and K03201-079 were 84% and 87%, respectively. In the event that the monomer level is lower than 80% molecules were submitted to a supplementary round of purification.

FIGS. 34A-34H: Evaluation of IL-15 activity after MMP-9-mediated cleavage of the ICC. Relative IL-15 activity is determined using the IL-15 Bioassay (Promega) and expressed as luminescence. ICC were cleaved by MMP-9 (dotted lines) or not (solid lines) prior to the assay. (A) Molecules without cofactor; clockwise, from top left: K03201-002, K03201-076, K03201-073; (B) Molecule with sushi/covalent; clockwise, from top left: K03201-034, K03201-046, K03201-074; (C) Molecule with sushi+/covalent; clockwise, from top left: K03201-069, K03201-072, K03201-075; (D) Molecule with sushi+/coexpression; left: K03201-077, right: K03201-071; (E) Molecule with sIL-15Rα/coexpression; left: K03201-027, right: K03201-070; (F) Molecules with 9G4 antibody; clockwise, from top left: K03201-086, K03201-029, K00901-006; (G) Molecules with NHS76 antibody; clockwise, from top left: K03001-002, K03001-025, K03001-023; (H) Molecules with NHS76 antibody; left: K03001-024, right: K03001-026.

Figure 35:
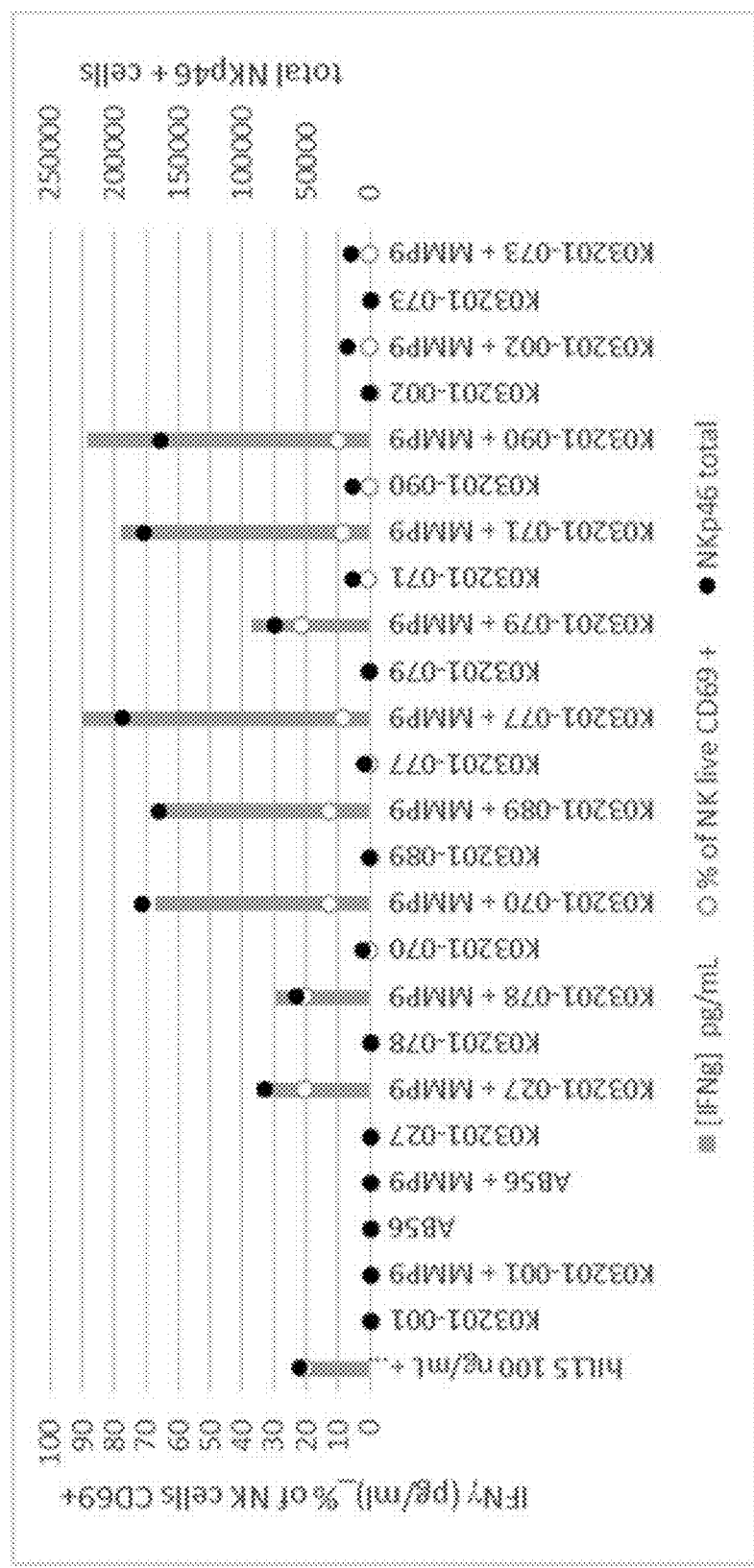

FIG. 35: Evaluation of ICC construct activity in a NK cell assay. The bars represent levels of IFNγ produced in pg/mL, open circles the % of CD69+ NK cells, and filled circles total NKp46+ NK cells.

Figure 36:
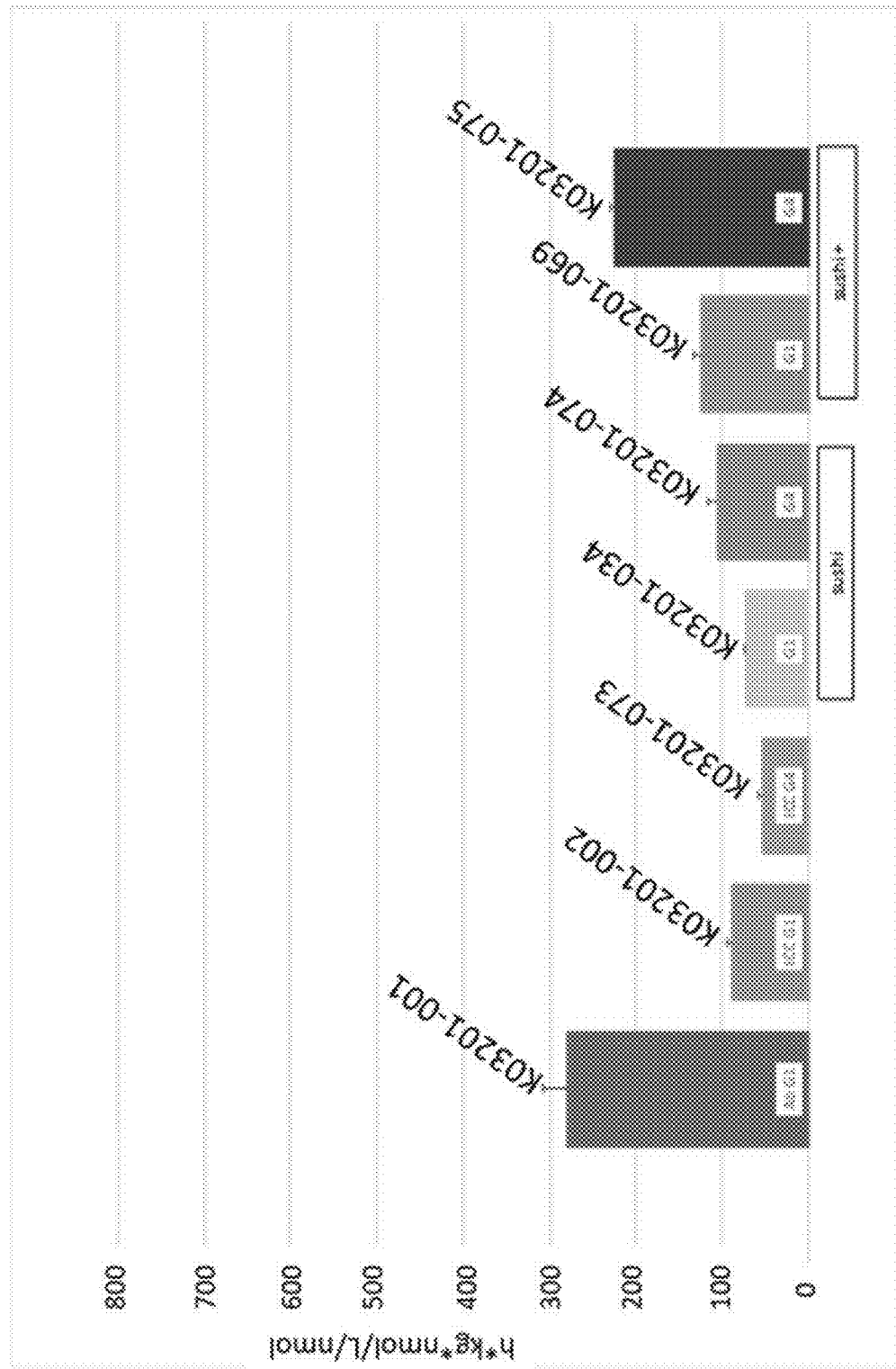

FIG. 36: AUC(0-last)/dose for total antibody measured in mouse plasma after a single IV dosing in study 1.

Figure 37A:
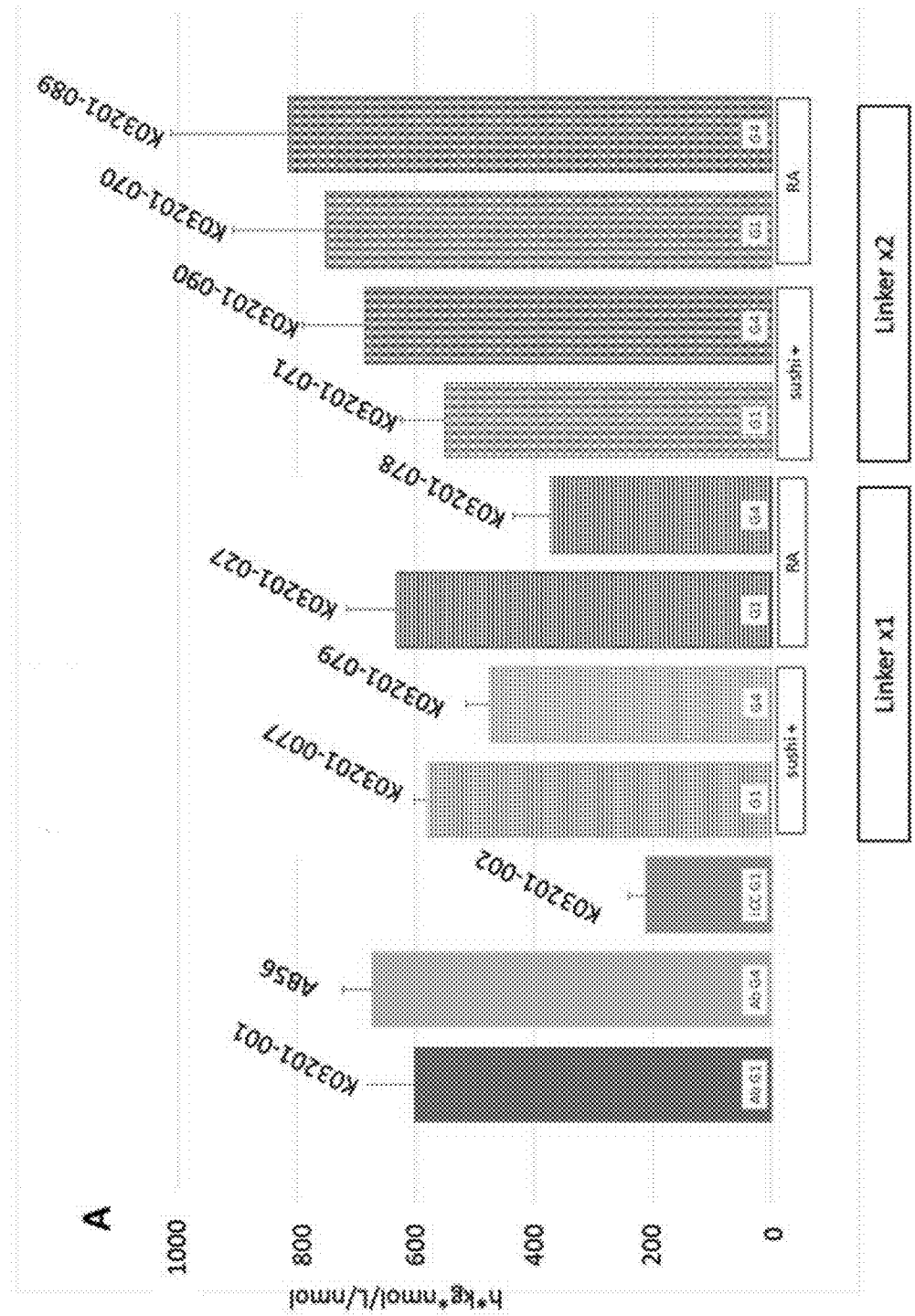
Figure 37B:
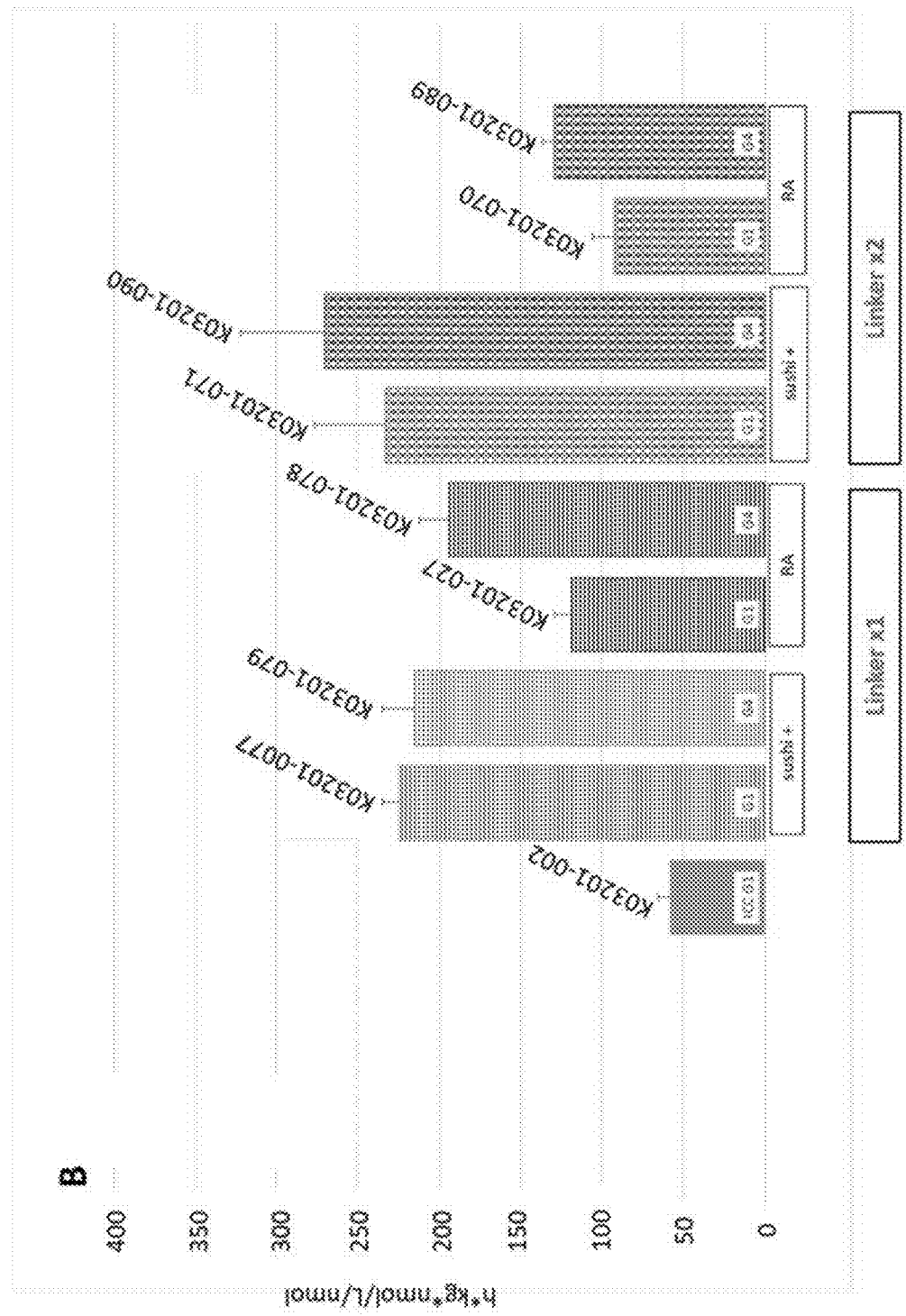

FIG. 37A-37B: AUC(0-last)/dose for (A) total antibody and (B) total ICC measured in mouse plasma after a single IV dosing in study 2.

Figure 38:
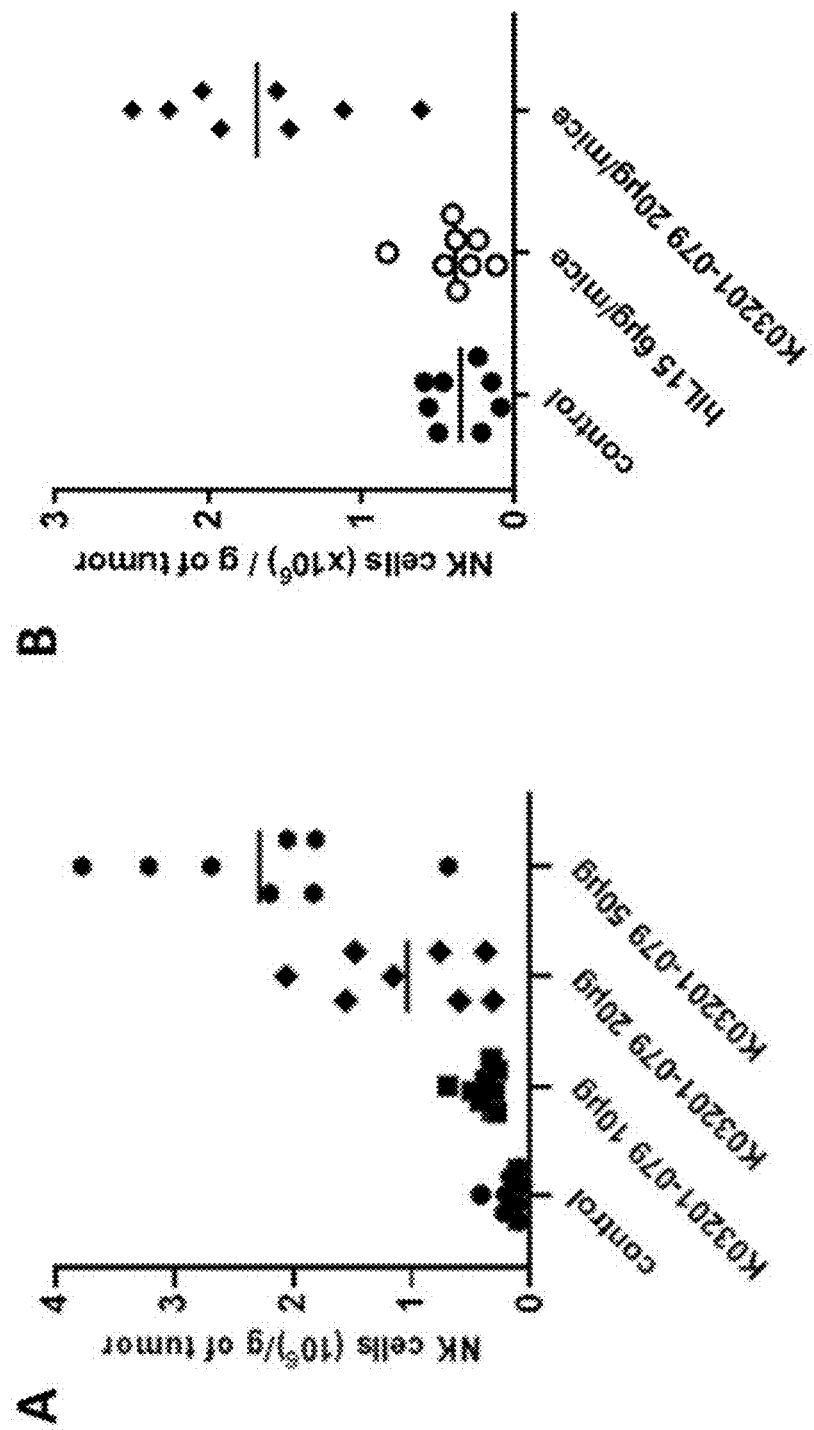

FIG. 38: In vivo effect of K03201-079 on NK cells in a renal cell carcinoma model. (A) Evaluation of in vivo effect of K03201-079 on NK cells in the RENCA model. (B) Comparison of in vivo effect of K03201-079 and rIL-15 on NK cells in the RENCA model.

DESCRIPTION

It was surprisingly found that the specific combination of an antibody fused to a cytokine moiety which can be selectively released upon cleavage of a cleavable peptide linker, provides for a new and therapeutically effective fusion protein.

The present invention relates to an "immunocytokine", i.e., a fusion between an antibody or a fragment or a derivative thereof and a cytokine. The antibody moiety in the present immunocytokine targets the tumour where the cytokine is released to exert its action. This confers greater specificity to the fusion protein, i.e. it generates fewer side effects than immunocytokines of the prior art which merely rely on localised proteolysis for targeting cytokine activity to the tumour (Skrombolas et al., 2019).

Whereas other immunocytokines of the prior art either did not contain any linker or contained a merely structural linker (i.e., a linker without any specific biological activity) between the antibody and the cytokine, the present fusion protein comprises a peptide linker which can be cleaved between the two moieties, allowing better control of the therapeutic activity of the molecule. Indeed, the inventors have found that the fusion protein is surprisingly inactive in the blood but is activated upon reaching the tumour site. The cleavable peptide linker is preferentially cleaved in the tumour microenvironment, thus releasing the cytokine. Targeted delivery of the cytokine thus potentiates its anti-tumour activity, whilst reducing the risks of cytokine-associated toxicity.

In a first aspect, the invention relates to a fusion protein comprising an antibody, or antigen-binding protein thereof, a cleavable peptide linker, and a cytokine or a functional fragment thereof.

A "fusion protein" refers to a chimeric protein encoding two or more separate protein sequences that are recombinantly expressed as a single moiety. This term is meant to encompass all conjugates, wherein said antibody, or antigen-binding protein thereof is somehow bound to the cleavable peptide linker and the cytokine or functional fragment thereof, by, e.g. covalent and/or non-covalent, e.g. ionic bonds. The term encompasses all binding arrangements. Preferred arrangements include antibody—linker—cytokine and cytokine—linker—antibody.

Antibodies

An "antibody" as used herein refers to an immunoglobulin (Ig) molecule capable of specific binding to a target, the "antigen", such as a carbohydrate, polynucleotide, lipid, polypeptide, etc., through at least one antigen recognition site, located in the variable region of the immunoglobulin molecule. The antibody or antigen-binding protein thereof of the present fusion protein mediates the targeted delivery of immunocytokines into disease environments and/or to specific cell subsets. Preferred target antigens are those that are overexpressed in diseased tissues, while remaining at low levels elsewhere. Such antigens are well-known to the skilled person, as-they have been the subject of numerous studies over the years. For example, the antibody moiety of the present immunocytokine may target antigens overexpressed on the surface of malignant cells (e.g., epithelial cell adhesion molecule, EGFR, IGF-1R, GD2 disialoganglioside, HER2/neu, CD20 and CD30), as well as targeting of neoangiogenic antigens found in tumours and chronic inflammation sites (e.g., fibronectin, splice variants EDA/EDB and A1 domain of tenascin C).

As used herein, the term "antibody" encompasses not only intact polyclonal or monoclonal antibodies, but also any antigen binding fragment (i.e., "antigen-binding fragment") or single chain thereof, fusion proteins comprising an antibody, and any other modified configuration of the immunoglobulin molecule that comprises an antigen recognition site including, for example without limitation, scFv, single domain antibodies {e.g., shark and camelid antibodies), maxibodies, minibodies, intrabodies, diabodies, triabodies, tetrabodies, v-NAR and bis-scFv. As used herein, the term "antibody" encompasses both full-length antibodies and their antigen-binding fragments, as well as any derivative thereof. Preferably, the antibody according to the invention, or its derived compounds or antigen-binding fragments, is a monoclonal antibody.

A "monoclonal antibody", as used herein, means an antibody arising from a nearly homogeneous antibody population. More particularly, the individual antibodies of a population are identical except for a few possible naturally-occurring mutations which can be found in minimal proportions. In other words, a monoclonal antibody consists of a homogeneous antibody arising from the growth of a single cell clone (for example a hybridoma, a eukaryotic host cell transfected with a DNA molecule coding for the homogeneous antibody, a prokaryotic host cell transfected with a DNA molecule coding for the homogeneous antibody, etc.) and is generally characterised by heavy chains of one and only one class and subclass, and light chains of only one type. Monoclonal antibodies are highly specific and are directed against a single antigen. In addition, in contrast with preparations of polyclonal antibodies which typically include various antibodies directed against various determinants, or epitopes, each monoclonal antibody is directed against a single epitope of the antigen. Since these antibodies are directed against a single epitope, they are highly specific.

An "epitope" is the site on the antigen to which binds the antibody. It can be formed by contiguous residues or by non-contiguous residues brought into close proximity by the folding of an antigenic protein. Epitopes formed by contiguous amino acids are typically retained on exposure to denaturing solvents, whereas epitopes formed by non-contiguous amino acids are typically lost under said exposure.

The generation of the antibody reactive with a specific antigen can be realised by any method known by the man skilled in the art, such as for example, fusion of a myeloma cell with spleen cells from immunised mice or other species compatible with the selected myeloma cells (Kohler & Milstein, Nature, 256:495-497, 1975). The immunised animals could include transgenic mice with human immunoglobulin loci which then directly produce human antibodies. Alternatively, an antibody can be generated by recombinant methods such as selection of libraries of recombinant antibodies in phage or similar vectors. In general, for the preparation of monoclonal antibodies or their functional fragments, especially of murine origin, it is possible to refer to techniques which are described in particular in the manual "Antibodies" (Harlow and Lane, Antibodies: A Laboratory Manual, Cold Spring Harbor Laboratory, Cold Spring Harbor N.Y., pp. 726, 1988) or to the technique of preparation from hybridomas described by Kohler and Milstein (Nature, 256:495-497, 1975).

An antibody includes an antibody of any class, such as IgG, IgA, or IgM (or subclass thereof), and the antibody need not be of any particular class. Depending on the antibody amino acid sequence of the constant region of its heavy chains, immunoglobulins can be assigned to different classes.

A typical IgG antibody is composed of two identical heavy chains and two identical light chains that are joined by disulphide bonds. Each heavy and light chain contains a constant region and a variable region. Each variable region contains three segments called "complementarity-determining regions" ("CDRs") or "hypervariable regions", which are primarily responsible for binding an epitope of an antigen. They are usually referred to as CDR1, CDR2, and CDR3, numbered sequentially from the N-terminus. The more highly conserved portions of the variable regions are called the "framework regions".

There are three heavy-chain CDRs and 3 light-chain CDRs. The term "CDR" or "CDRs" is used here in order to indicate, according to the case, one of these regions or several, or even the whole, of these regions which contain the majority of the amino acid residues responsible for the binding by affinity of the antibody for the antigen or the epitope which it recognises.

As used herein, "VH" or "$V_H$" refers to the variable region of an immunoglobulin heavy chain of an antibody, including the heavy chain of an Fv, scFv, dsFv, Fab, Fab', or F(ab')2 fragment. Reference to "VL" or "$V_L$" refers to the variable region of the immunoglobulin light chain of an antibody, including the light chain of an Fv, scFv, dsFv, Fab, Fab', or F(ab')2 fragment.

Antibody constant domains are not involved directly in binding an antibody to an antigen, but exhibit various effector functions. The heavy chain constant regions that correspond to the different classes of immunoglobulins are called α, δ, ε, γ, and p, respectively. Depending on the amino acid sequence of the constant region of their heavy chains, antibodies or immunoglobulins can be assigned to different classes, i.e., IgA, IgD, IgE, IgG, and IgM, and several of these may be further divided into subclasses (isotypes), e.g., IgG1, IgG2, IgG3, and IgG4; IgA1 and IgA2 (see, W. E. Paul, ed., 1993, Fundamental Immunology, Raven Press, New York, N.Y.).

Papain digestion of antibodies produces two identical antigen binding fragments, called Fab fragments, each with a single antigen binding site, and a residual "Fc" fragment. The crystal structure of the human IgG Fc domain has been determined (Deisenhofer, Biochemistry, 20, 2361-2370, 1981). As used in the specification and claims, "immunoglobulin Fc domain or Fc" means the carboxyl-terminal portion of the immunoglobulin heavy chain constant region. A "native sequence Fc domain", as used herein, comprises an amino acid sequence identical to the amino acid sequence of a Fc domain found in nature. Native sequence human Fc domains include a native sequence human IgG1 Fc domain (non-A and A allotypes); native sequence human IgG2 Fc domain; native sequence human IgG3 Fc domain; and native sequence human IgG4 Fc domain as well as naturally occurring variants thereof.

Although the boundaries of the Fc domain of an immunoglobulin heavy chain might vary, the human IgG heavy chain Fc domain is usually defined to stretch from an amino acid residue at position Cys226 or Pro230 in the hinge region, to the carboxyl-terminus thereof containing the CH2 and CH3 domain of the heavy chain. Throughout the present specification and claims, the numbering of the residues in an immunoglobulin heavy chain is that of the EU index as in Kabat et al., Sequences of Proteins of Immunological Interest, 5th Ed. Public Health Service, National Institutes of Health, Bethesda, Md. (1991). The "EU index as in Kabat" refers to the residue numbering of the human IgG1 EU antibody.

The term "hinge region" is generally defined as stretching from Glu216 to Pro230 of human IgG1 (Burton, Mol Immunol, 22: 161-206, 1985). Hinge regions of other IgG isotypes may be aligned with the IgG1 sequence by placing the first and last cysteine residues forming inter-heavy chain S—S bonds in the same positions. The "CH2 domain" of a human IgG Fc portion (also referred to as "Cy2" domain) usually extends from about amino acid 231 to about amino acid 340. The CH2 domain is unique in that it is not closely paired with another domain. Rather, two N-linked branched carbohydrate chains are interposed between the two CH2 domains of an intact native IgG molecule. It has been speculated that the carbohydrate may provide a substitute for the domain-domain pairing and help stabilize the CH2 domain (Burton, Mol Immunol, 22: 161-206, 1985). The "CH3 domain" comprises the stretch of residues C-terminal to a CH2 domain in an Fc portion (i.e., from about amino acid residue 341 to about amino acid residue 447 of an IgG).

The Fc domains are central in determining the biological functions of the immunoglobulin and these biological functions are termed "effector functions". These Fc domain-mediated activities are mediated via immunological effector cells, such as killer cells, natural killer cells, and activated macrophages, or various complement components. These effector functions involve activation of receptors on the surface of said effector cells, through the binding of the Fc domain of an antibody to the said receptor or to complement component(s). The antibody-dependent cellular cytotoxicity (ADCC) and complement-dependent cytotoxicity (CDC) activities involve the binding of the Fc domain to Fc-receptors such as FcγRI, FcγRII, FcγRIII of the effector cells or complement components such as C1q. Of the various human immunoglobulin classes, human IgG1l and IgG3 mediate ADCC more effectively than IgG2 and IgG4.

The antibodies of the invention also comprise chimeric or humanised antibodies.

A chimeric antibody is one containing a natural variable region (light chain and heavy chain) derived from an antibody of a given species in combination with constant regions of the light chain and the heavy chain of an antibody of a species heterologous to said given species.

The antibodies, or chimeric fragments of same, can be prepared by using the techniques of recombinant genetics. For example, the chimeric antibody could be produced by cloning recombinant DNA containing a promoter and a sequence coding for the variable region of a nonhuman monoclonal antibody of the invention, notably murine, and a sequence coding for the human antibody constant region. A chimeric antibody according to the invention coded by one such recombinant gene could be, for example, a mouse-human chimera, the specificity of this antibody being determined by the variable region derived from the murine DNA and its isotype determined by the constant region derived from human DNA. It will be appreciated that in this case, the Fc domain of the chimeric antibody is of human origin. Refer to Verhoeyn et al. (BioEssays, 8:74, 1988) for methods for preparing chimeric antibodies.

In addition, the invention also relates to humanised antibodies arising from the murine antibodies described above. "Humanised antibody" refers herein to an antibody that contains CDR regions derived from an antibody of nonhuman origin, the other parts of the antibody molecule being derived from one (or several) human antibodies. In addition, some of the skeleton segment residues (called FR) can be modified to preserve binding affinity (Jones et al., Nature, 321:522-525, 1986; Verhoeyen et al., Science, 239:1534-1536, 1988; Riechmann et al., Nature, 332:323-327, 1988). The Fc domain of a humanised antibody will be of human origin, as in chimeric antibodies.

The humanised antibodies of the invention or fragments of same can be prepared by techniques known to a person skilled in the art (such as, for example, those described in the documents Singer et al., J. Immun., 150:2844-2857, 1992; Mountain et al., Biotechnol. Genet. Eng. Rev., 10:1-142, 1992; and Bebbington et al., Bio/Technology, 10: 169-175, 1992). Such humanised antibodies are preferred for their use in methods involving in vitro diagnoses or preventive and/or therapeutic treatment in vivo. Other humanisation techniques, also known to a person skilled in the art, such as, for example, the "CDR grafting" technique described by PDL in patents EP 0 451 261, EP 0 682 040, EP 0 939 127, EP 0 566 647 or U.S. Pat. Nos. 5,530,101, 6,180,370, 5,585,089 and 5,693,761. U.S. Pat. Nos. 5,639,641 or 6,054,297, 5,886,152 and 5,877,293 can also be cited.

Although it is possible to use antibody fragments in the present immunocytokines, it is preferred to use full-length, bivalent antibodies. A monovalent antibody such as a Fab or a scFv has only a single binding site for an antigen (as distinct from natural 'bivalent' antibodies), i.e., is composed of a single antigen-binding arm. As known to the skilled person, the greater an immunoglobulin's valency (number of antigen binding sites), the greater the amount of antigen it can bind. There is a significant affinity change between monovalent and bivalent bindings with usually a ca. 1,500-fold change in Kd values. Bivalent antibodies can thus be used at a lower dose to attain similar therapeutic efficiency as monovalent Fab or scFv fragments, thus limiting the risks of secondary effects.

Preferably, the antibody which can be used in the immunocytokines described herein is an antibody which does not bind specifically the cytokine moiety of said immunocytokine. For example, if the cytokine is IL-12, the antibody according to this embodiment is not an antibody which binds IL-12.

In another embodiment the antibody used in the present immunocytokine is an antibody which binds specifically a tumour-associated antigens (TAA) or a tumour-specific antigens (TSA). As used herein, a "tumour-associated antigen" is a protein or other molecule that is found on cancer cells whilst a "tumour-specific antigen" is a protein or other molecule that is found on cancer cells and not on normal cells.

Tumour-specific antigens are known in the art Tumour antigens can be classified in a variety of ways. Tumour antigens include antigens encoded by genes that have undergone chromosomal alteration. Many of these antigens are found in lymphoma and leukaemia. Even within this classification, antigens can be characterised as those that involve activation of quiescent genes. These include BCL-1 and IgH (Mantel cell lymphoma), BCL-2 and IgH (Follicular lymphoma), BCL-6 (Diffuse large B-cell lymphoma), TAL-1 and TCR delta or SIL (T-cell acute lymphoblastic leukaemia), c-MYC and IgH or IgL (Burkitt lymphoma), MUN/IRF4 and IgH (Myeloma), PAX-5 (BSAP) (Immunocytoma).

Other tumour antigens that involve chromosomal alteration and thereby create a novel fusion gene and/or protein include RARoa, PML, PLZF, NPMor NuM4 (Acute promyelocytic leukaemia), BCR and ABL (Chronic myeloid/acute lymphoblastic leukaemia), MLL (HRX) (Acute leukaemia), E2A and PBX or HLF (B-cell acute lymphoblastic leukaemia), NPM, ALK (Anaplastic large cell leukaemia), and NPM, MLF-1 (Myelodysplastic syndrome/acute myeloid leukaemia).

Other tumour antigens are specific to a tissue or cell lineage. These include cell surface proteins such as CD20, CD22 (Non-Hodgkin's lymphoma, B-cell lymphoma, Chronic lymphocytic leukaemia (CLL)), CD52 (B-cell CLL), CD33 (Acute myelogenous leukaemia (AML)), CD 10 (gp100) (Common (pre-B) acute lymphocytic leukaemia and malignant melanoma), CD3/T-cell receptor (TCR) (T-cell lymphoma and leukaemia), CD79/B-cell receptor (BCR) (B-cell lymphoma and leukaemia), CD26 (Epithelial and lymphoid malignancies), Human leukocyte antigen (HLA)-DR, HLA-DP, and HLA-DQ (Lymphoid malignancies), RCAS1 (Gynaecological carcinomas, biliary adenocarcinomas and ductal adenocarcinomas of the pancreas), and Prostate specific membrane antigen (Prostate cancer).

Tissue- or lineage-specific tumour antigens also include epidermal growth factor receptors (high expression) such as EGFR (HER1 or erbB1) and EGFRvIII (Brain, lung, breast, prostate and stomach cancer), erbB2 (HER2 or HER2/neu) (Breast cancer and gastric cancer), erbB3 (HER3) (Adenocarcinoma), and erbB4 (HER4) (Breast cancer).

Tissue- or lineage-specific tumour antigens also include cell-associated proteins such as Tyrosinase, Melan-A/MART-1, tyrosinase related protein (TRP)-1/gp75 (Malignant melanoma), Polymorphic epithelial mucin (PEM) (Breast tumours), and Human epithelial mucin (MUC1) (Breast, ovarian, colon and lung cancers).

Tissue- or lineage-specific tumour antigens also include secreted proteins such as Monoclonal immunoglobulin (Multiple myeloma and plasmacytoma), Immunoglobulin light chains (Multiple Myeloma), alpha-fetoprotein (Liver carcinoma), Kallikreins 6 and 10 (Ovarian cancer), Gastrin-releasing peptide/bombesin (Lung carcinoma), and Prostate specific antigen (Prostate cancer).

Still other tumour antigens are cancer testis (CT) antigens that are expressed in some normal tissues such as testis and in some cases placenta. Their expression is common in tumours of diverse lineages and as a group the antigens form targets for immunotherapy. Examples of tumour expression of CT antigens include MAGE-A1, -A3, -A6, -A12, BAGE, GAGE, HAGE, LAGE-1, NY-ESO-1, RAGE, SSX-1, -2, -3, -4, -5, -6, -7, -8, -9, HOM-TES-14/SCP-1, HOM-TES-85 and PRAME. Still other examples of CT antigens and the cancers in which they are expressed include SSX-2, and -4 (Neuroblastoma), SSX-2 (HOM-MEL-40), MAGE, GAGE, BAGE and PRAME (Malignant melanoma), HOM-TES-14/SCP-1 (Meningioma), SSX-4 (Oligodendroglioma), HOM-TES-14/SCP-1, MAGE-3 and SSX-4 (Astrocytoma), SSX member (Head and neck cancer, ovarian cancer, lymphoid tumours, colorectal cancer and breast cancer), RAGE-1, -2, -4, GAGE-1-2, -3, -4, -5, -6, -7 and -8 (Head and neck squamous cell carcinoma (HNSCC)), HOM-TES14/SCP-1, PRAME, SSX-1 and CT-7 (Non-Hodgkin's lymphoma), and PRAME (Acute lymphoblastic leukaemia (ALL), acute myelogenous leukaemia (AML) and chronic lymphocytic leukaemia (CLL)).

Other tumour antigens are not specific to a particular tissue or cell lineage. These include members of the carcinoembryonic antigen (CEA) family: CD66a, CD66b, CD66c, CD66d and CD66e. These antigens can be expressed in many different malignant tumours and can be targeted by immunotherapy.

Still other tumour antigens are viral proteins and these include Human papilloma virus protein (cervical cancer), and EBV-encoded nuclear antigen (EBNA)-1 (lymphomas of the neck and oral cancer).

Still other tumour antigens are mutated or aberrantly expressed molecules such as but not limited to CDK4 and beta-catenin (melanoma).

In some embodiments, the antigen is a tumour antigen. The tumour antigen may be selected from the group consisting of MART-1/Melan-A, gp100, adenosine deaminase-binding protein (ADAbp), FAP, cyclophilin b, colorectal associated antigen (CRC)-C017-1A/GA733, carcinoembryonic antigen (CEA), CAP-1, CAP-2, etv6, AML1, prostate specific antigen (PSA), PSA-1, PSA-2, PSA-3, prostate-specific membrane antigen (PSMA), T-cell receptor/CD3-zeta chain, and CD20. The tumour antigen may also be selected from the group consisting of MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-C5). In still another embodiment, the tumour antigen is selected from the group consisting of GAGE-1, GAGE-2, GAGE-3, GAGE-4, GAGE-5, GAGE-6, GAGE-7, GAGE-8, GAGE-9. And in yet a further embodiment, the tumour antigen is selected from the group consisting of BAGE, RAGE, LAGE-1, NAG, GnT-V, MUM-1, CDK4, tyrosinase, p53, MUC family, HER2/neu, p21 ras, RCAS 1, α-fetoprotein, E-cadherin, α-catenin, β-catenin, .gamma.-catenin, p120ctn, gp100Pmel117, PRAME, NY-ESO-1, cdc27, adenomatous polyposis coli protein (APC), fodrin, Connexin 37, Ig-idiotype, p15, gp75, GM2 ganglioside, GD2 ganglioside, human papilloma virus proteins, Smad family of tumour antigens, Imp-1, P1A, EBV-encoded nuclear antigen (EBNA)-1, brain glycogen phosphorylase, SSX-1, SSX-2 (HOM-MEL-40), SSX-1, SSX-4, SSX-5, SCP-1 and CT-7, and c-erbB-2.

Cancer or tumour antigens can also be classified according to the cancer or tumour they are associated with (i.e., expressed by). Cancers or tumours associated with tumour antigens include acute lymphoblastic leukaemia (etv6; am11; cyclophilin b), B cell lymphoma (Ig-idiotype); Burkitt's (Non-Hodgkin's) lymphoma (CD20); glioma (E-cadherin; α-catenin; β-catenin; .gamma.-catenin; p120ctn), bladder cancer (p21ras), biliary cancer (p21ras), breast cancer (MUC family; HER2/neu; c-erbB-2), cervical carcinoma (p53; p21ras), colon carcinoma (p21ras; HER2/neu; c-erbB-2; MUC family), colorectal cancer (Colorectal associated antigen (CRC)-0017-1A/GA733; APC), choriocarcinoma (CEA), epithelial cell-cancer (cyclophilin b), gastric cancer (HER2/neu; c-erbB-2; ga733 glycoprotein), hepatocellular cancer (α-fetoprotein), Hodgkin's lymphoma (Imp-1; EBNA-1), lung cancer (CEA; MAGE-3; NY-ESO-1), lymphoid cell-derived leukaemia (cyclophilin b), melanoma (p15 protein, gp75, oncofoetal antigen, GM2 and GD2 gangliosides), myeloma (MUC family; p21 ras), non-small cell lung carcinoma (HER2/neu; c-erbB-2), nasopharyngeal cancer (Imp-1; EBNA-1), ovarian cancer (MUC family; HER2/neu; c-erbB-2), prostate cancer (Prostate Specific Antigen (PSA) and its immunogenic epitopes PSA-1, PSA-2, and PSA-3; PSMA; HER2/neu; c-erbB-2), pancreatic cancer (p21ras; MUC family; HER2/neu; c-erbB-2; ga733 glycoprotein), renal (HER2/neu; c-erbB-2), squamous cell cancers of cervix and oesophagus (viral products such as human papilloma virus proteins and non-infectious particles), testicular cancer (NY-ESO-1), T cell leukaemia (HTLV-1 epitopes), and melanoma (Melan-A/MART-1; cdc27; MAGE-3; p21ras; gp100$^{Pmel117}$). More preferably, the antibody of the present immunocytokine is an antibody which does not bind specifically the cytokine moiety of said immunocytokine, but binds specifically a tumour-associated antigens (TAA) or a tumour-specific antigens (TSA).

Examples of antibodies which can be used in the present invention include: Alemtuzumab (CD52), Alirocumab (PCSK9), Arcitumomab (Human CEA (carcinoembryonic antigen)), Atezolizumab (PD-L1), Avelumab (PD-L1), AVE1642 (IGF-1R), Basiliximab (CD25 (a chain of IL-2 receptor)), Belimumab (BLyS), Bevacizumab (VEGF), Blinatumomab (CD19), Brodalumab (IL-17RA), Capromab (Tumour surface antigen PSMA), Catumaxomab (EpCAM and CD3), Catumaxomab (EpCAM), Certolizumab pegol (TNFa), Cetuximab (EGFR), Cixutumumab (IGF-1R), Daclizumab (CD25 (a chain of IL2 receptor)), Dalotuzumab (IGF-1R), Daratumumab (CD38), Dinutuximab (GD2), Dupilumab (IL-4Rα), Durvalumab (PD-L1), Efalizumab (CD11a), Elotuzumab (SLAMF7), Evolocumab (LDL-C/PCSK9), Fanolesomab (CD15), Figitumumab (IGF-1R), Ganitumab (IGF-1R), Golimumab (TNFa), Ibritumomab tiuxetan (CD20), Infliximab (TNFα), Ipilimumab (CTLA-4), Necitumumab (EGFR), Nivolumab (PD-1), Nofetumomab (Carcinoma-associated antigen), Obinutuzumab (CD20), Ocrelizumab (CD20), Ofatumumab (CD20), Olaratumab (PDGFR-α), Panitumumab (EGFR), Pembrolizumab (PD-1), Pertuzumab (HER2), Ramucirumab (VEGF), Ranibizumab (VEGF-A), Rituximab (CD20), Siltuximab (cCLB8), Tocilizumab (IL-6 receptor), Trastuzumab (HER-2), Vedolizumab (Integrin-α4α7), Votumumab (Cytokeratin tumour-associated antigen).

Cleavable Peptide Linkers

A "peptide linker" as used herein refers to an amino acid stretch between two different peptide or polypeptide subunits, e.g. between an antibody and a cytokine. Linkers have often been used in the art. They generally adopt an extended conformation to allow for maximal flexibility. In addition, they may contain a site recognised by an enzyme.

A "cleavable peptide linker" as used herein refers to a polyvalent linker covalently bonded to an antibody, or an antigen-binding fragment thereof, and covalently bonded to a cytokine, or fragment thereof, which is enzymatically cleavable (e.g. at a cleavage site). According to the invention, upon hydrolysis (proteolytic cleavage) of the cleavable peptide linker, the cytokine moiety, preferably IL-15, is released, enabling it to exert its therapeutic activity. In preferred embodiments the cleavable peptide linker is recombinantly expressed as part of the immunocytokine. In other embodiments, the cleavable peptide linker is a linker formed by reacting a functional (reactive) group attached to the linker with an antibody, or an antigen-binding fragment thereof using, for example, conjugate chemistry. In yet other embodiments, the cleavable peptide linker is a linker formed by reacting a functional (reactive) group attached to the linker with a cytokine, or fragment thereof, using, for example, conjugate chemistry. In a preferred embodiment, the cleavable peptide linker connects the cytokine, or fragment thereof, to the heavy chain of the antibody, or an antigen-binding fragment thereof. In another embodiment, the cleavable peptide linker connects the cytokine, or fragment thereof, to the light chain of the antibody, or an antigen-binding fragment thereof. The cleavable peptide linker may connect the cytokine, or fragment thereof, to the N-terminus of one of the heavy and light chains of the antibody, or an antigen-binding fragment thereof. It is also possible that the cleavable peptide linker connects the cytokine, or fragment thereof, to the C-terminus of the heavy and light chains of the antibody, or an antigen-binding fragment thereof. Most preferably, the cleavable peptide linker connects the cytokine, or fragment thereof, to the N-terminus or C-terminus of the heavy chain of the antibody, or an antigen-binding fragment thereof.

In some embodiments, the immunocytokine may contain only one cleavable peptide linker. In some other embodiments, the immunocytokine may contain more than one cleavable peptide linker. Preferably, in that case, the more than one cleavable peptide linker are contiguous, i.e. they are attached one to the other, with the cleavable peptide linker at one end being bound to the antibody and the cleavable peptide linker at the other end being bound to the cytokine, preferably IL-15, or a functional fragment thereof. In a particular embodiment, the immunocytokine may comprise at least 1, at least 2, at least 3; at least 4, at least 5 cleavable peptide linkers. In a specific embodiment, the immunocytokine comprises 2 cleavable peptide linkers.

The cleavable peptide linker provided herein may include a protease cleavage site.

A "cleavage site" as used herein, refers to a recognisable site for cleavage of a portion of a linker (e.g. cleavable peptide linker as described hereinabove) present in an immunocytokine described herein. Thus, a cleavage site may be found in the sequence of a cleavable peptide linker as described herein, including embodiments thereof. In embodiments, the cleavage site is an amino acid sequence that is recognised and cleaved by a cleaving agent (e.g. a peptidyl sequence). Exemplary cleaving agents include proteins, enzymes, DNAzymes, RNAzymes, metals, acids, and bases. Exemplary cleavage sites are defined herein (see FIG. 7). They notably include PVGLIG (SEQ ID NO: 44), also referred to herein as L6, and dimers thereof (PVGLIGPVGLIG, SEQ ID NO: 202, L6-L6).

A "protease cleavage site" as used herein is a cleavage site which is recognised and specifically cleaved by a protease. According to a preferred embodiment, the protease cleavage site is a tumour-associated protease cleavage site. A "tumour-associated protease cleavage site" as used herein refers to an amino acid sequence recognised by a protease, whose expression is specific for a tumour cell or tumour cell environment thereof or mainly expressed in the tumour cell or tumour environment compared to healthy tissues or is only/mainly active in the tumour cell or tumour environment. In embodiments, the protease cleavage site is a matrix metalloprotease (MMP) cleavage site, a prostate specific antigen (PSA) protease cleavage site, a membrane type serine protease 1 (MT-SP1) protease cleavage site, a uPA urokinase plasminogen activator cleavage site, or a legumain protease cleavage site. In some embodiments, the matrix metalloprotease (MMP) cleavage site is a MMP 9 cleavage site, a MMP 13 cleavage site, or a MMP 2 cleavage site. Protease cleavage sites may be designated by a specific amino acid sequence but may also encompass any variation of this canonical amino acid sequence which is still recognised and cleaved by the protease of interest.

Preferably, the cleavable peptide linker is a matrix metalloprotease (MMP) cleavage site. More preferably, the cleavable peptide linker comprises a MMP 9 cleavage site or a MMP 2 cleavage site. Examples of MMP cleavage sites include GPLGIAGQ (SEQ ID NO: 38), GPLGLWAQ (SEQ ID NO: 40), GPLGMLSQ (SEQ ID NO: 42), PLGLAG (SEQ ID NO: 36), and PVGLIG (SEQ ID NO: 44).

In another preferred embodiment, the cleavable peptide linker is a urokinase plasminogen activator (uPA) cleavage site. Examples of uPA cleavage sites include SGRS (SEQ ID NO: 166), SGRSA (SEQ ID NO: 168), and PSSRRRVN (SEQ ID NO: 170).

The term "MMP 2" or "MMP 2 protease" as used herein refers to the matrix metalloproteinase 2 (MMP 2). MMP-2 is the protein identified by the NCBI sequence reference GI: 189217853. The term "MMP-9" or "MMP9 protease" as used herein refers to the matrix metalloproteinase 9 (MMP-9). MMP9 is the protein identified by the NCBI sequence reference GI: 74272287. The term "MMP 13" or "MMP 13 protease" as used herein refers the matrix metalloproteinase 13 (MMP 13). MMP 13 is the protein identified by the NCBI sequence reference GL4505209. The term "PSA" or "PSA protease" as used herein refers to the prostate-specific antigen (PSA), also known as gamma seminoprotein or kallikrein-3. PSA is the protein identified by the NCBI sequence reference GL71834853. The term "PSMA" or "PSMA protease" as used herein refers to the prostate-specific membrane antigen (PSMA), also known as glutamate carboxypeptidase II (GCPII), N-acetyl-L-aspartyl-L-glutamate peptidase I (NAALADase I) or NAAG peptidase. PSMA is the protein identified by the NCBI sequence reference GL62548858. The term "fibroblast associated protein" as used herein refers to the fibroblast associated protein. Fibroblast associated protein is the protein as identified by the NCBI sequence reference GL 1888316. The term "MT-SPL" or "MT-SPL protease" as used herein refers to the membrane type serine protease 1 (MT-SPL). MT-SPL is the protein identified by the NCBI sequence reference GI: 1 1415040. The term "legumain" or "legumain protease" as used herein refers to the legumain protein. Legumain is the protein identified by the NCBI sequence reference GL2842759. The term uPA as used herein refers to the urokinase-type plasminogen activator identified by the NCBI sequence reference Gene ID: 5328.

In some embodiment, the cleavable peptide linker comprises at least 2, at least 3, at least 4, at least 5, at least 6, at least 7, at least 8, at least 9, at least 10, at last 11, at least 12, or at least 13 amino acids. In other embodiments, cleavable peptide linkers are 5-mers (i.e. peptides 5 amino acids in length), 6-mers (i.e. peptides 6 amino acids in Length), 7-mers (i.e. peptides 7 amino acids in Length), 8-mers (i.e. peptides 8 amino acids in length), 9-mers (i.e. peptides 9 amino acids in length), 10-mers (i.e. peptides 10 amino acids in Length), 11-mers (i.e. peptides 11 amino acids in length), 12-mers (i.e. peptides 12 amino acids in length), or 13-mers (i.e. peptides 13 amino acids in length).

Most preferably, said the sequence of said cleavage peptide linker is selected from the group consisting of: GPLGIAGQ (SEQ ID NO: 38), GPLGLWAQ (SEQ ID NO: 40), GPLGMLSQ (SEQ ID NO: 42), PLGLAG (SEQ ID NO: 36), PVGLIG (SEQ ID NO: 44), SGRS (SEQ ID NO: 166), SGRSA (SEQ ID NO: 168), and PSSRRRVN (SEQ ID NO: 170).

Cytokines

The term "cytokine" as used herein refers to a member of a family of small secreted regulatory proteins which have an effect on the immune system. Cytokines are involved in cell-to-cell communication and regulate many cellular functions, such as cell survival and growth, as well as induction of the expression of many genes. Secretion of cytokines thus enables the rapid propagation of immune signalling in a multifaceted and efficient manner. Cytokines regulate the nature, intensity and duration of the immune response by exerting a variety of effects on lymphocytes and/or other cells. Indeed, cytokines are usually classified into pro- and anti-inflammatory cytokines. Some cytokines are also capable of mobilising the immune system to fight cancer (see e.g., Floros & Tarhini, *Semin Oncol.* 42(4): 539-548, 2015). Cytokines can be produced by many cell types, including immune and non-immune cells. Examples of cytokines include interleukins, lymphokines, monokines, interferons, colony stimulating factors, and chemokines, inter alia. A "cytokine" as used herein may be any one of IL-1, IL-2, IL-3, IL-4, IL-5, IL-6, IL-7, IL-8, IL-9, IL-10, IL-11, IL-12, IL-13, IL-15, IL-16, IL-17, IL-18, IL-19, IL-20, IL-21, IL-22, IL-23, IL-24, IL-26, IL-28, IL-29, IL-33, IL-36, IL-37, IL-38, IFN-α (including IFN-α1/13, IFN-α2, IFN-α4, IFN-α5, IFN-α6, IFN-α7, IFN-α8, IFN-α10, IFN-α14, IFN-α16, IFN-α17, and IFN-α21), IFN-β, IFN-γ, IFN-λ, TNF-α, TNF-β, TGF-β1, M-CSF, G-CSF, GM-CSF, and CXL10. According to the invention, the cytokine is preferably inactivated or attenuated when linked to the ICC and became active only after cleavage of ICC by the protease.

The term "functional fragment" with regard to said cytokines is to be interpreted essentially in analogy to the same term for antibodies (see below). Functional fragments and derivatives of cytokines are those that essentially have the same physiological function/activity as the naturally occurring cytokines.

In a preferred embodiment, the cytokine is IL-15. By "IL-15" or "interleukin-15", it is herein referred to a cytokine that regulates T and natural killer cell activation and proliferation. Interleukin-15 (IL-15) is a 14 to 15 kDa member of the 4α-helix bundle family of cytokines composed of 114 amino acids whose sequence is available under the accession number NP_000576.1. There is 97% sequence identity between human and simian IL-15 and 73% between human and mouse. This appears to be sufficient for huIL-15 to render it biologically active on simian and murine cells.

IL-15 displays high structural similarity to Interleukin-2 (IL-2). Like IL-2, IL-15 binds to and signals through a complex composed of IL-2/IL-15 receptor beta chain (CD122) and the common gamma chain (gamma-C, CD132). Specificity of the signalling is ensured by IL-15 being recognised by the alpha unit of its receptor (IL-15Rα), whilst IL-2 binds IL-2Rα. IL-15 stimulates the production of proinflammatory cytokines (e.g. TNFα, IL-1, IFNγ), the proliferation and Ig synthesis of activated B cells, the activation of $T_H1$, monocytes and lymphokine activated killer cells, the proliferation of mast cells and T cells and inhibits the apoptosis of T and B cells. In addition to the mentioned functional activities IL-15 plays a pivotal role in the development, survival and function of NK cells [Joost J. Oppenheim et al., Cytokine Reference; 213-221, (2002)]. IL-15 is a cytokine that primarily stimulates the proliferation and cytotoxic functions of CD8T cells and NK cells leading to enhanced anti-tumour responses (Waldmann, *J Investig Dermatol Symp Proc.* 16(1): 528-30, 2013). While initially showing promise as a cancer therapeutic, the efficacy of IL-15 was limited by its short in vivo half-life. However, new IL-15-based therapies have been developed and are currently in clinical trials (Robinson & Schluns, *Immunol Lett.* 190: 159-168, 2017). The inventors have now shown that IL-15 is not active when fused to an antibody moiety and becomes activated only when released by the cleavage of the linker. Immunocytokines comprising IL-15 localise in vivo to the tumour where they are cleaved. This allows for circumventing the short half-life problem. In addition, the active cytokine is delivered to the site where it is needed, reducing the risks of side effects.

In another preferred embodiment, the cytokine is CXCL10. By "CXCL10" or "C-X-C motif chemokine 10" or "interferon gamma-induced protein 10" or "IP10", it is herein referred to an 8.7-kDa CXC chemokine which functions to recruit activated and memory lymphocytes to sites of inflammation. The secreted bioactive form (after cleavage of the signal peptide) is a polypeptide of 77 residues (corresponding to positions 22-98 of NP_001556), herein designated "long CXCL10", which binds the CXCR3 receptor. CXCL10 signalling through the chemokine receptor CXCR3 has an important role in lymphocyte migration and function. Notably, CXCL10 appears to enhance T cell-dependent anti-cancer immunity (Karin et Razon, *Cytokine*, 109:24-28, 2018).

In another preferred embodiment, the cytokine is IL-36. As used herein, the expressions "IL-36" or "hIL-36" or "Interleukin-36" refers to a subgroup of the IL-1 family with pro-inflammatory properties (see e.g. Murrieta-Coxca, *Int J Mol Sci.*, 20(7). pii: E1649, 2019). By "IL-36", it is notably referred to IL-36a (IL-1F6), IL-36β (IL-1F8), and IL-36γ (IL-1F9). As used herein, "IL-36α" refers to a 158-amino acid protein whose sequence is available under the accession number NP_055255, "IL-36β" a 157-amino acid protein with 2 isoforms (accession numbers: NP_055253 and NP_775270), and "IL-36γ" a 169-amino acid protein with 2 isoforms (accession numbers: NP_001265497 and NP_062564). IL-36α, IL-36β, and IL-36γ are agonist ligands with pro-inflammatory activity. They promote the induction of various inflammatory mediators including cytokines, chemokines, growth factors, and antimicrobial peptides. All of them use the same receptor, IL-36R, which dimerises with IL-1RAcP to activate intracellular signalling cascades. This pathway culminates with the expression of inflammatory cytokines driven by AP-1 (activator protein 1) and NF-kB transcription factors.

In yet another preferred embodiment, the cytokine is IFNα. As used herein, the expressions "IFNα" or "IFN-α" or "Interferon α" refer to a subtype of human type-I interferons (IFN-I), a large subgroup of interferon proteins that help regulate the activity of the immune system. All IFN-I, including IFN-α, bind to a specific cell surface receptor complex known as the IFN-α receptor (IFNAR) that consists of IFNAR1 and IFNAR2 chains (see e.g., López de Padilla & Niewold, *Gene,* 576(1 Pt 1): 14-21, 2016). There are 12 functional human IFN-α proteins (IFN-α1/13, IFN-α2, IFN-α4, IFN-α5, IFN-α6, IFN-α7, IFN-α8, IFN-α10, IFN-α14, IFN-α16, IFN-α17, and IFN-α21), all of which exhibit high homology in their primary, secondary, and tertiary structures. Each of the IFNA genes (IFNA1, IFNA2, IFNA3, IFN4, IFN5, IFN6, IFN7, IFN8, IFNA10, IFNA14, IFNA16, IFNA17, and IFNA21) encode a pre-protein comprising a 23 amino acid signal peptide which is cleaved upon secretion, resulting in a mature 166-residue protein (Uniprot accession number: Q6QNB6) except for IFN-2 which is composed of 165 amino acids only (Uniprot accession number: P01563). Indeed, the aspartic acid residue present at position 44 in other subtypes of IFN-α is missing in IFN-α2.

According to this embodiment, the invention relates to a fusion protein comprising:
(i) an antibody or antigen-binding fragment thereof fused to
(ii) a cleavable peptide linker, and
(iii) a cytokine, preferably IL-15, CXCL10, IL-36, or IFN-α, or functional fragments thereof.

Protein Complex

In another aspect, the present disclosure provides a protein complex which comprises a protein fusion as described above and a cofactor.

The immunocytokine described herein is surprisingly even more effective when complexed with a specific cofactor. Not only the activity of the immunocytokine is still tightly controlled, i.e., the cytokine moiety is only activated when released at the tumour site, but the presence of the cofactor results in an immunocytokine with a longer half-life in the plasma. This is particularly advantageous since lower doses are needed to reach similar therapeutic effects as the immunocytokine alone.

Moreover, the present protein complex of immunocytokine and cofactor can surprisingly be produced at high levels and with a high degree of purity. The expression of the immunocytokine in the presence of the cofactor, either as a fusion or by coexpression, results in higher yields than in the absence, and with lower levels of aggregates. Smaller culture volumes and fewer expression steps are needed to obtain therapeutically active amounts of the immunocytokine. Expressing the cofactor with the immunocytokine, as a fusion protein or not, thus improves the quantity and quality of the efficient expression and production of this valuable biomolecule while minimising time and cost.

As used herein, the "protein complex" of the present invention refers to a protein formed by binding of two different monomeric proteins.

In a first embodiment, the invention thus relates to a protein complex comprising:
i) a fusion protein comprising an antibody, or antigen-binding fragment thereof, a cleavable peptide linker, and a cytokine or a functional fragment thereof; and
ii) a cofactor.

In the present disclosure, the two monomeric proteins are the immunocytokine and the cofactor. The cofactor may or may not be covalently linked to the fusion protein. In an embodiment, the cofactor is covalently bound to the fusion protein. In another embodiment, the cofactor is not covalently bound to the fusion protein.

In an embodiment, the cytokine is IL-15. In another embodiment, the cofactor is IL-15Rα or an IL-15-binding fragment thereof. In another embodiment, the cytokine is IL-15 and the cofactor is IL-15Rα or an IL-15-binding fragment thereof.

Cofactors

The term "cofactor" as used herein refers to a compound which is capable of interacting with the cytokine moiety, such as e.g., IL-15, of the immunocytokine.

By "interaction" or "interact," it is meant any type of physical association between proteins, whether covalent or non-covalent. Examples of non-covalent bonds include electrostatic bonds, hydrogen bonds, and Van der Waals forces. Furthermore, the interactions between proteins may either be direct or indirect. Depending upon the type of interaction present, various methods may be used to measure the level of interaction. For example, the strengths of covalent bonds are often measured in terms of the energy required to break a certain number of bonds (i.e., kcal/mol). Non-covalent interactions are often described as above, and also in terms of the distance between the interacting molecules. Indirect interactions may be described in a number of ways, including the number of intermediary agents involved, or the degree of control exercised over the one interacting polypeptide over the other.

Preferably, the cofactor is capable of binding to the cytokine moiety (e.g., IL-15). By "binding", "binds", or the like, it is meant a direct interaction between the cofactor and the immunocytokine, thus forming a complex which is relatively stable under physiological conditions. Methods for determining whether two molecules bind are well known in the art and include, for example, equilibrium dialysis, surface plasmon resonance, and the like. In a particular embodiment, said cofactor thereof, binds to the cytokine moiety with an affinity that is at least two-fold greater than its affinity for binding to a non-specific molecule such as BSA or casein.

Preferably, the cofactor is a protein or a fragment thereof which is capable of binding the cytokine moiety, such as IL-15. For example, the cofactor may be the physiological receptor for the cytokine, or a cytokine-binding fragment thereof.

In a preferred aspect, the cofactor is a receptor for IL-15 or an IL-15-binding fragment thereof.

IL-15 binds and signals through a high affinity receptor, IL-15R, which comprises the IL-2Rβ-chain and IL-2Rγ-chain. These two subunits are also part of the IL-2 receptor (IL-2R). Binding specificity for IL-15 or IL-2 is conferred by a third subunit, i.e. IL-15R alpha-chain (IL-15Rα) or IL-2R alpha-chain, respectively. IL-15Rα is capable of binding IL-15 independently of other subunits.

Preferably, the cofactor is IL-15Rα or an IL-15-binding fragment thereof.

As used herein, "IL-15Rα" or "IL-15R alpha-chain" can be any IL-15Rα from any species, such as human or non-human mammalian IL-15Rα or non-mammal IL-15Rα. Exemplary non-human mammals comprise such as pigs, rabbits, monkeys, chimpanzees, mice, and the like; non-mammals comprise such as chickens and the like. Preferably, "IL-15Rα" as used herein refers human IL-15Rα, i.e., a 267-residue polypeptide (Uniprot accession number: Q13261) encoded by the human IL-15RA gene ((Gene ID: 3601). "IL-15Rα" as used herein also encompasses all isoforms and variants of this polypeptide, provided they bind to IL-15. Isoforms which do not bind to IL-15 include isoforms 5, 6, 7, and 8, as described on the Uniprot web site. Variants of IL-15Rα which are still capable of binding IL-15 are known in the art (see e.g., EP 3 235 830 A1). IL-15Rα is a transmembrane polypeptide, whose extracellular domain is responsible for binding IL-15. This extracellular domain can be generated by proteolysis shedding of the membrane-anchored receptor.

The cofactor may also be an IL-15-binding fragment of IL-15Rα, such as a soluble IL-15Rα (sIL-15Rα). As used herein, "soluble IL-15Rα" or "sIL-15Rα" refer to the extracellular domain of IL-15Rα. Preferably, sIL-15Rα has the sequence represented by SEQ ID NO: 210. The sIL-15Rα polypeptide is capable of binding IL-15 independently of other polypeptides. This binding is notably mediated by a specific structural domain, called the sushi domain, present in the IL-15Rα extracellular domain. Sushi domain, also known as Complement control protein (CCP) module, or short consensus repeat (SCR), is an evolutionary conserved protein domain characterised by a consensus sequence spanning—60 residues containing four invariant cysteine residues forming two disulphide-bridges (I-Ill and II-IV), a highly conserved tryptophan, and conserved glycine, proline, and hydrophobic residues. ILR15α comprises a unique sushi domain, which is located between residues 31 and 95 of the receptor's extracellular domain. Preferably, the IL-15-binding fragment of IL-15Rα comprises the sushi domain present in this receptor. More preferably, the IL-15-binding fragment of IL-15Rα consists of the IL-15Rα sushi domain. Even more preferably, the IL-15Rα sushi domain has the sequence represented by SEQ ID NO: 206. Alternatively, the IL-15-binding fragment of IL-15Rα provided herein encompasses molecules comprising a sushi domain obtained by one or more amino acid substitutions, insertions or deletions. In particular, the IL-15-binding fragment of IL-15Rα may comprise the sushi domain and additional amino acids of IL-15Rα. For example, the IL-15-binding fragment may further comprise at least 5, at least 10, at least 15 additional amino acids of IL-15Rα. More preferably, the IL-15 binding fragment consists of the sushi domain and 11 additional IL-15Rα residues. This polypeptide is herein referred to as "sushi+" or "IL-15Rα sushi+". Specifically, IL-15Rα sushi+ as used herein has the sequence represented by SEQ ID NO: 208.

Accordingly, the invention relates to a protein complex comprising:
i) a fusion protein comprising an antibody, or antigen-binding fragment thereof, a cleavable peptide linker, and IL-15 or a functional fragment thereof; and ii) IL-15Rα or an IL-15-binding fragment thereof,
wherein the IL-15-binding fragment is selected in the group consisting of: soluble IL-15Rα of SEQ ID NO: 210, IL-15Rα sushi of SEQ ID NO: 206, and IL-15Rα sushi+ of SEQ ID NO: 208.

The cofactor may be covalently linked to the immunocytokine. In a first embodiment, the cofactor is bound to the immunocytokine by a peptide bond. For example, the cofactor may be expressed in a fusion with the immunocytokine. The cofactor may be linked to the antibody moiety. In such a case, the cofactor may be fused to the same immunoglobulin chain as the cytokine (e.g., IL-15) or a functional fragment thereof, or it may be fused to the other chain. Alternatively, the cofactor may be directly linked to the cytokine, e.g. IL-15, or a functional fragment thereof. This configuration is preferred as it seems to be more favourable to the binding of the cofactor to the cytokine moiety of the immunocytokine.

According to this embodiment, the present protein complex comprises:
i) a fusion protein comprising an antibody, or antigen-binding fragment thereof, a cleavable peptide linker, and IL-15 or a functional fragment thereof; and
ii) IL-15Rα or an IL-15-binding fragment thereof,
wherein the IL-15-binding fragment is selected in the group consisting of: soluble IL-15Rα of SEQ ID NO: 210, IL-15Rα sushi of SEQ ID NO: 206, and IL-15Rα sushi+ of SEQ ID NO: 208, and
IL-15Rα or the IL-15-binding fragment thereof covalently linked to the fusion protein, preferably to IL-15 or the functional fragment thereof.

When the cofactor (e.g. IL-15Rα or an IL-15-binding fragment thereof) is fused to the immunocytokine (e.g., IL-15 or a functional fragment thereof), the cofactor may be separated from the immunocytokine by a linker. Preferably, the peptide linker is an unstructured flexible linker. Without being bound by theory, it is thought that a cofactor may interact more easily and more efficiently with the cytokine moiety, e.g. IL-15, or a functional fragment thereof, when the linker is flexible and does not present any specific structure. Preferably, the linker is not a cleavable linker, as described above. Preferably, the linker mostly comprises glycine and serine residues. In some embodiment, the peptide linker comprises at least 2, at least 3, at least 4, at least 5, at least 10, at least 15, at least 20, at least 25, or at least 30 amino acids. In other embodiments, cleavable peptide linkers are 2-mers (i.e. peptides 2 amino acids in length), 3-mers (i.e. peptides 3 amino acids in length), 4-mers (i.e. peptides 4 amino acids in length), 5-mers (i.e. peptides 5 amino acids in length), 10-mers (i.e. peptides 10 amino acids in length), 15-mers (i.e. peptides 15 amino acids in length), 20-mers (i.e. peptides 20 amino acids in length), 25-mers (i.e. peptides 25 amino acids in length), or 30-mers (i.e. peptides 30 amino acids in length). If the sequence of the linker peptide is too short, the advanced structure folding of two proteins may be affected, and thus interfered with each other; if the sequence of the linker peptide is too long, the problem of immunogenicity is concerned, since the linker peptide sequence itself is a new antigen.

The cofactor may also be conjugated to the immunocytokine by use of a chemical crosslinker, which results in a protein conjugate that contains two individual polypeptides connected by a crosslinker.

Alternatively, the cofactor may bind to the immunocytokine through non-covalent interactions. Preferably, the cofactor binds to the cytokine moiety of the immunocytokine through non-covalent interactions. In non-covalent interactions (e.g., electrostatic, hydrogen bonding and Van der Waals interactions), although the interaction energy per unit interaction is quite small (less than 40 kJ/interaction), the cumulative effect of multiple points of interaction along two surfaces can be substantial and can lead to strong binding between two polypeptides. In the present embodiment, the multiple interactions between the cytokine, or functional fragment thereof, and the cofactor ensure the formation of a stable complex which retains its activity when administered in vivo. For example, the combination of IL-15 with sIL-15Rα in solution results in the generation of a complex with high biological potency, the IL-15 super-agonist (IL-15 SA), which is undergoing clinical trials as N-803 (Guo et al., *Cytokine Growth Factor Rev.* 38: 10-21, 2017).

According to this embodiment, the present protein complex comprises:
i) a fusion protein comprising an antibody, or antigen-binding fragment thereof, a cleavable peptide linker, and IL-15 or a functional fragment thereof; and
ii) IL-15Rα or an IL-15-binding fragment thereof,
wherein the IL-15-binding fragment is selected in the group consisting of: soluble IL-15Rα of SEQ ID NO: 210, IL-15Rα sushi of SEQ ID NO: 206, and IL-15Rα sushi+ of SEQ ID NO: 208, and
IL-15Rα or the IL-15-binding fragment thereof is linked non-covalently to the fusion protein, preferably to IL-15 or the functional fragment thereof.

Methods of Identification of Peptide Cleavage Linkers and Cytokines

The inventors have shown that it is possible to identify linkers suitable for use in the present fusion proteins. The experimental data show that several linkers can be discriminated according to whether they are cleaved or not in vitro. The relevance of these in vitro results is emphasised by the fact that all the linkers thus identified are cleaved in vivo, thus liberating an active cytokine at the site of the tumour.

Thus, in another aspect, a method of selecting a peptide cleavable linker is herein provided. This method comprises the steps of:
(i) providing a fusion protein as described herein, said fusion protein comprising the peptide cleavable linker to be tested;
(ii) contacting said fusion protein with the relevant protease; and
(iii) detecting the cleavage of said fusion protein.

In an embodiment, the method is carried out in vitro. In another embodiment, the method is carried out in vivo. According to this specific embodiment, step (ii) of the method comprises administering the fusion protein of step (i) to a mammal, preferably a rodent, most preferably a mouse.

Detection of the cleavage of the linker can be performed by any means available to the person of skills in the art. It may be notably performed using specific antibodies, in particular using well known technologies such as immunoprecipitation with specific antibodies, western blot, ELISA or ELISPOT, antibodies microarrays, or tissue microarrays coupled to immunohistochemistry. Other suitable techniques include FRET or BRET, single cell microscopic or histochemistry methods using single or multiple excitation wavelength and applying any of the adapted optical methods, such as electrochemical methods (voltammetry and amperometry techniques), atomic force microscopy, and radio frequency methods, e.g. multipolar resonance spectroscopy, confocal and non-confocal, detection of fluorescence, luminescence, chemiluminescence, absorbance, reflectance, transmittance, and birefringence or refractive index (e.g., surface plasmon resonance, ellipsometry, a resonant mirror method, a grating coupler waveguide method or interferometry), cell ELISA, flow cytometry, radioisotopic, magnetic resonance imaging, analysis by polyacrylamide gel electrophoresis (SDS-PAGE); HPLC-Mass Spectroscopy; Liquid Chromatography/Mass Spectrometry/Mass Spectrometry (LC-MS/MS)).

Alternatively, the cleavage of the linker can also be detected with a functional test. Notably, the hydrolysis of the linker releases an active cytokine moiety, whereas said cytokine moiety was attenuated when part of the fusion protein. In this embodiment, step (iii) of the method comprises measuring the activity of the cytokine moiety. Preferably, step (iii) further comprises comparing the activity of the cytokine moiety of said fusion protein which has been contacted with the relevant protease in step (ii), with the activity of the cytokine moiety of said fusion protein which has not been contacted with the protease. According to a preferred embodiment, the linker is cleaved if the activity of the cytokine moiety of said fusion protein which has been contacted with the relevant protease in step (ii), is increased at least 2-fold, preferably at least 3-fold, preferably at least 4-fold, preferably at least 5-fold, preferably at least 10-fold, preferably at least 20-fold, preferably at least 50-fold, preferably at least 100-fold, relative to the activity of the cytokine moiety of the untreated fusion protein. More preferably, the linker is cleaved if the activity of the cytokine moiety is increased at least 10-fold.

In addition, it is immediately apparent that cytokines and variants thereof can be easily tested for their suitability in the present immunocytokines. A "cytokine variant" as used herein refers to a cytokine which differs from a main species cytokine. For example, a cytokine variant may have an amino acid sequence which differs from a main species cytokine. Ordinarily, variants will possess at least about 70% homology with the main species cytokine, and preferably, they will be at least about 80%, and more preferably at least about 90% homologous with the main species cytokine. The cytokine variants possess substitutions, deletions, and/or additions at certain positions within or adjacent to the amino acid sequence of the main species cytokines. Alternatively, the cytokine variant may differ from a main species cytokine in at least one post-translational modification. For example, the cytokine variant may carry one or more carbohydrate moieties attached thereto which differ from one or more carbohydrate moieties attached to a main species antibody.

Thus, in another aspect, a method of selecting a cytokine or a variant thereof is herein provided. This method comprises the steps of:
  (i) providing a fusion protein as described herein, said fusion protein comprising the cytokine or variant thereof to be tested;
  (ii) contacting said fusion protein with the relevant protease; and
  (iii) detecting the activity of said cytokine.

In an embodiment, the method is carried out in vitro. In another embodiment, the method is carried out in vivo. According to this specific embodiment, step (ii) of the method comprises administering the fusion protein of step (i) to a mammal, preferably a rodent, most preferably a mouse.

If the cytokine or the variant is suitable for use in an immunocytokine as described herein, the hydrolysis of the linker will release an active cytokine moiety, whereas said cytokine moiety is attenuated when part of the fusion protein. In this embodiment, step (iii) of the method comprises measuring the activity of the cytokine moiety. Preferably, step (iii) further comprises comparing the activity of the cytokine moiety of said fusion protein which has been contacted with the relevant protease in step (ii), with the activity of the cytokine moiety of said fusion protein which has not been contacted with the protease. According to a preferred embodiment, the cytokine or cytokine variant is active if the activity of the cytokine moiety of said fusion protein which has been contacted with the relevant protease in step (ii), is increased at least 2-fold, preferably at least 3-fold, preferably at least 4-fold, preferably at least 5-fold, preferably at least 10-fold, preferably at least 20-fold, preferably at least 50-fold, preferably at least 100-fold, relative to the activity of the cytokine moiety of the untreated fusion protein. More preferably, the cytokine or cytokine variant is active if said activity is increased at least 10-fold.

The skilled person will know how to measure the activity of the cytokine moiety depending upon the nature of said cytokine. Cytokine activity can be determined by a variety of methods including but not limited to the techniques of enzyme fragment complementation (Eglen J Biomol Screen. 2004 August; 9(5):398-408), proximity ligation assay (Andersen et al. Cytokine. 2013 October; 64(1):54-7) NF-κB translocation (Trask 2012, Assay Guidance Manual [Internet]. Bethesda (Md.): Eli Lilly & Company and the National Center for Advancing Translational Sciences; 2004-2012 Oct. 1.) Beta-arrestin recruitment (Wang Assay Guidance Manual [Internet]. Bethesda (Md.): Eli Lilly &t Company and the National Center for Advancing Translational Sciences; 2004-2017 Nov. 20.) Bioluminescence Resonance Energy Transfer (Compan Methods Mol Biol. 2016; 1417: 89-95). These methods have been used for a wide range of cytokines and can be easily adapted to the needs of the particular cytokine of interest as required.

The skilled person will in particular refer to the experimental section of the present application, wherein instances of such assays are described.

Polynucleotides

Also provided herein are polynucleotides comprising a nucleotide sequence encoding a fusion protein as described above. Also provided herein are polynucleotides that hybridise under high stringency, intermediate or lower stringency hybridisation conditions, e.g., as defined supra, to polynucleotides that encode a fusion protein or modified fusion protein provided herein.

In certain embodiments, nucleic acid molecules provided herein comprise or consist of a nucleic acid sequence encoding a $V_H$ or a $V_L$ amino acid sequence fused to a cleavable peptide linker and a cytokine, as provided herein. In other embodiments, nucleic acid molecules provided herein comprise or consist of a nucleic acid sequence encoding a $V_H$ or a $V_L$ amino acid sequence which is not fused to additional sequences. In yet other embodiments, the nucleic acid molecules provided herein comprise or consist of combinations of a nucleic acid sequence encoding a $V_H$ or a $V_L$ amino acid sequence fused to a cleavable peptide linker and a cytokine and of a nucleic acid sequence encoding a $V_H$ or a $V_L$ amino acid sequence which is not fused to additional sequences. Preferably, a nucleic acid sequence encoding a $V_H$ amino acid sequence fused to a cleavable peptide linker and a cytokine is combined with a nucleic acid sequence encoding a $V_L$ amino acid sequence which is not fused to additional sequences. Alternatively, said combination comprises a nucleic acid sequence encoding a $V_L$ amino acid sequence fused to a cleavable peptide linker and a cytokine and a nucleic acid sequence encoding a $V_H$ amino acid sequence which is not fused to additional sequences.

In addition, the disclosure provides polynucleotides comprising a nucleotide sequence encoding a fusion protein or a cofactor as described above. Also provided herein are polynucleotides that hybridise under high stringency, intermediate or lower stringency hybridisation conditions, e.g., as defined supra, to polynucleotides that encode a fusion protein or cofactor provided herein.

In a first aspect, one or more polynucleotides provided herein encode a protein complex wherein the cofactor (e.g., IL-15Rα or an IL-15-binding fragment thereof) is covalently linked to the fusion protein (e.g., an immunocytokine comprising IL-15 or a functional fragment thereof), as described above. In certain embodiments, nucleic acid molecules provided herein comprise or consist of a nucleic acid sequence encoding a $V_H$ or a $V_L$ amino acid sequence fused to a cleavable peptide linker and a cytokine, notably IL-15, and a cofactor, such as IL-R15α, and optionally a linker, as provided herein. In other embodiments, nucleic acid molecules provided herein comprise or consist of a nucleic acid sequence encoding a $V_H$ or a $V_L$ amino acid sequence which is not fused to additional sequences. In yet other embodiments, the nucleic acid molecules provided herein comprise or consist of combinations of a nucleic acid sequence encoding a $V_H$ or a $V_L$ amino acid sequence fused to a cleavable peptide linker and a cytokine, notably IL-15, and a cofactor, such as IL-R15α, and optionally a linker, and of a nucleic acid sequence encoding a $V_H$ or a $V_L$ amino acid sequence which is not fused to additional sequences. Preferably, a nucleic acid sequence encoding a $V_H$ amino acid sequence fused to a cleavable peptide linker and a cytokine, notably IL-15, and a cofactor, such as IL-R15α, and optionally a linker, is combined with a nucleic acid sequence encoding a $V_L$ amino acid sequence which is not fused to additional sequences. Alternatively, said combination comprises a nucleic acid sequence encoding a $V_L$ amino acid sequence fused to a cleavable peptide linker and a cytokine, notably IL-15, and a cofactor, such as IL-R15α, and optionally a linker, and a nucleic acid sequence encoding a $V_H$ amino acid sequence which is not fused to additional sequences.

In another aspect, the fusion protein and the cofactor encoded by the polynucleotides provided herein interact through non-covalent interactions. In certain embodiments, nucleic acid molecules provided herein comprise or consist of a nucleic acid sequence encoding a $V_H$ or a $V_L$ amino acid sequence fused to a cleavable peptide linker and a cytokine, as provided herein. In other embodiments, nucleic acid molecules provided herein comprise or consist of a nucleic acid sequence encoding a $V_H$ or a $V_L$ amino acid sequence which is not fused to additional sequences. In yet other embodiments, nucleic acid molecules provided herein comprise or consist of a nucleic acid sequence encoding a cofactor as described herein. In yet other embodiments, the nucleic acid molecules provided herein comprise or consist of combinations of a nucleic acid sequence encoding a $V_H$ or a $V_L$ amino acid sequence fused to a cleavable peptide linker and a cytokine, a nucleic acid sequence encoding a $V_H$ or a $V_L$ amino acid sequence which is not fused to additional sequences, and a nucleic acid sequence encoding a cofactor.

Preferably, a nucleic acid sequence encoding a $V_H$ amino acid sequence fused to a cleavable peptide linker and a cytokine is combined with a nucleic acid sequence encoding a $V_L$ amino acid sequence which is not fused to additional sequences and with a nucleic acid sequence encoding the cofactor. Alternatively, said combination comprises a nucleic acid sequence encoding a $V_L$ amino acid sequence fused to a cleavable peptide linker and a cytokine and a nucleic acid sequence encoding a $V_H$ amino acid sequence which is not fused to additional sequences and a nucleic acid sequence encoding the cofactor.

Recombinant Expression of an Immunocytokine or a Protein Complex

A variety of expression systems may be used to express the present immunocytokines as described herein. Likewise, the protein complex described herein can be expressed using any of a number of expression systems. The skilled person will be able to choose an expression system appropriate for expressing the immunocytokine and cofactor described herein, either as a fusion (i.e. when the cofactor is covalently linked to the immunocytokine) or by coexpression (i.e. when the immunocytokine and the cofactor are bound non-covalently). The expression of the cofactor with the immunocytokine, be they covalently or non-covalently bound, leads to higher yields and lower levels of aggregation (i.e., a higher purity) of the immunocytokine than expression of the immunocytokine alone.

In one aspect, such expression systems represent vehicles by which the coding sequences of interest may be produced and subsequently purified, but also represent cells which may, when transiently transfected with the appropriate nucleotide coding sequences, express an antibody of the invention in situ.

The invention provides vectors comprising the polynucleotides described herein. In one embodiment, the vector contains a polynucleotide encoding a heavy chain of the immunocytokine of the invention, wherein said heavy chain is fused or not to a cleavable peptide linker and a cytokine. In another embodiment, said polynucleotide encodes the light chain of an immunocytokine of the invention, wherein said light chain is fused or not to a cleavable peptide linker and a cytokine. In another embodiment, the vector contains a polynucleotide encoding a heavy chain of the immunocytokine provided herein, wherein said heavy chain is fused or not to a cleavable peptide linker and a cytokine. In this embodiment, the immunocytokine may be fused or not to the cofactor. In another embodiment, said polynucleotide encodes the light chain of an immunocytokine of the invention, wherein said light chain is fused or not to a cleavable peptide linker and a cytokine. In this embodiment, the immunocytokine may be fused or not to the cofactor. In yet another embodiment, the polynucleotide encodes the cofactor. The invention also provides vectors comprising polynucleotide molecules encoding fusion proteins, modified antibodies, antibody fragments, and probes thereof.

In order to express the heavy and/or light chain of an immunocytokine and/or the cofactor disclosed herein, the polynucleotides encoding said heavy and/or light chains and/or cofactor are inserted into expression vectors such that the genes are operatively linked to transcriptional and translational sequences.

"Operably linked" sequences include both expression control sequences that are contiguous with the gene of interest and expression control sequences that act in trans or at a distance to control the gene of interest. The term "expression control sequence" as used herein refers to polynucleotide sequences which are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include promoter, ribosomal binding site, and transcription termination sequence; in eukaryotes, generally, such control sequences include promoters and transcription termination sequence. The term "control sequences" is intended to include, at a minimum, all components whose presence is essential for expression and processing and can also include additional components whose presence is advantageous, for example, leader sequences and fusion partner sequences.

The term "vector", as used herein, is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome.

Certain vectors are capable of directing the expression of genes to which they are operatively linked. Such vectors are referred to herein as "recombinant expression vectors" (or simply, "expression vectors"). In general, expression vectors of utility in recombinant DNA techniques are in the form of plasmids. In the present specification, "plasmid" and "vector" may be used interchangeably as the plasmid is the most commonly used form of vector. However, the invention is intended to include such forms of expression vectors, such as bacterial plasmids, YACs, cosmids, retrovirus, EBV-derived episomes, and all the other vectors that the one skilled in the art will know to be convenient for ensuring the expression of the heavy and/or light chains of the antibodies of the invention. The skilled man will realise that the polynucleotides encoding the heavy and the light chains can be cloned into different vectors or in the same vector. In a preferred embodiment, said polynucleotides are cloned into two vectors. When the immunocytokine is to be expressed with a cofactor, the polynucleotides encoding the heavy and the light chains and the cofactor can be cloned into different vectors or in the same vector. In a preferred embodiment, said polynucleotides are cloned into at least two vectors. In particular, when the immunocytokine and the cofactor are expressed as a fusion, said polynucleotides are preferably cloned in at least two vectors. When the immunocytokine and the cofactor are co-expressed, i.e. not as a fusion, said polynucleotides are preferably cloned in at least one, preferably at least two, preferably three vectors.

Polynucleotides of the invention and vectors comprising these molecules can be used for the transformation of a suitable host cell. The term "host cell", as used herein, is intended to refer to a cell into which a recombinant expression vector has been introduced in order to express the present immunocytokine. It should be understood that such terms are intended to refer not only to the particular subject cell but also to the progeny of such a cell. Because certain modifications may occur in succeeding generations due to either mutation or environmental influences, such progeny may not, in fact, be identical to the parent cell, but are still included within the scope of the term "host cell" as used herein.

Transformation can be performed by any known method for introducing polynucleotides into a cell host. Such methods are well known of the man skilled in the art and include dextran-mediated transformation, calcium phosphate precipitation, polybrene-mediated transfection, protoplast fusion, electroporation, encapsulation of the polynucleotide into liposomes, biolistic injection and direct microinjection of DNA into nuclei.

The host cell may be co-transfected with two or more expression vectors, including the vector expressing the protein of the invention. In particular, the other expression vectors may encode enzymes involved in post-translational modifications, such as glycosylation. For example, a host cell can be transfected with a first vector encoding an immunocytokine or a protein complex as described above, and a second vector encoding a glycosyltransferase polypeptide. Alternatively, the host cell can be transformed with a first vector encoding an immunocytokine or a protein complex, a second vector encoding a glycosyltransferase, as described above, and a third vector encoding another glycosyltransferase. Mammalian cells are commonly used for the expression of a recombinant therapeutic immunoglobulins, especially for the expression of whole recombinant antibodies, and are thus particularly suited for expressing immunocytokines or a protein complex. For example, mammalian cells such as HEK293 or CHO cells, in conjunction with a vector, containing the expression signal such as one carrying the major intermediate early gene promoter element from human cytomegalovirus, are an effective system for expressing the present immunocytokine (Foecking et al., 1986, Gene 45:101-105; Cockett et al., 1990, Bio/Technology 8:662-667).

It is also possible to select a host cell which modulates the expression of the inserted sequences or modifies and processes the gene product in the specific fashion desired. Such modifications (e.g., glycosylation) and processing of protein products may be important for the function of the protein. Different host cells have features and specific mechanisms for the post-translational processing and modification of proteins and gene products. Appropriate cell lines or host systems are chosen to ensure the correct modification and processing of the expressed immunocytokine and/or cofactor of interest. Hence, eukaryotic host cells which possess the cellular machinery for proper processing of the primary transcript, glycosylation of the gene product may be used. Such mammalian host cells include, but are not limited to, CHO, COS, HEK293, NS/0, BHK, Y2/0, 3T3 or myeloma cells (all these cell lines are available from public depositories such as the Collection Nationale des Cultures de Microorganismes, Paris, France, or at the American Type Culture Collection, Manassas, Va., U.S.A.).

For long-term, high-yield production of recombinant proteins, stable expression is preferred. In one embodiment of the invention, cell lines which stably express the immunocytokine and/or cofactor may be engineered. Rather than using expression vectors which contain viral origins of replication, host cells are transformed with DNA under the control of the appropriate expression regulatory elements, including promoters, enhancers, transcription terminators, polyadenylation sites, and other appropriate sequences known to the person skilled in art, and a selectable marker. Following the introduction of the foreign DNA, engineered cells may be allowed to grow for one to two days in an enriched media, and then are moved to a selective media. The selectable marker on the recombinant plasmid confers resistance to the selection and allows cells to stably integrate the plasmid into a chromosome and be expanded into a cell line. Other methods for constructing stable cell lines are known in the art. In particular, methods for site-specific integration have been developed. According to these methods, the transformed DNA under the control of the appropriate expression regulatory elements, including promoters, enhancers, transcription terminators, polyadenylation sites, and other appropriate sequences is integrated in the host cell genome at a specific target site which has previously been cleaved (Moele et al., *Proc. Natl. Acad. Sci. U.S.A.*, 104(9): 3055-3060; U.S. Pat. Nos. 5,792,632; 5,830,729; 6,238,924; WO 2009/054985; WO 03/025183; WO 2004/067753, all of which are incorporated herein by reference).

A number of selection systems may be used, including but not limited to the Herpes simplex virus thymidine kinase (Wigler et al., *Cell* 11:223, 1977), hypoxanthine-guanine phosphoribosyltransferase (Szybalska et al., *Proc Natl Acad Sci USA* 48:202, 1992), glutamate synthase selection in the presence of methionine sulfoximide (*Adv Drug Del Rev*, 58:671, 2006, and website or literature of Lonza Group Ltd.) and adenine phosphoribosyltransferase (Lowy et al., *Cell* 22:817, 1980) genes in tk, hgprt or aprt cells, respectively. Also, antimetabolite resistance can be used as the basis of selection for the following genes: dhfr, which confers resistance to methotrexate (Wigler et al., *Proc Natl Acad Sci USA* 77: 357, 1980); gpt, which confers resistance to mycophenolic acid (Mulligan et al., *Proc Natl Acad Sci USA* 78: 2072, 1981); neo, which confers resistance to the aminoglycoside, G-418 (Wu et al., *Biotherapy* 3: 87, 1991); and hygro, which confers resistance to hygromycin (Santerre et al., *Gene* 30: 147, 1984). Methods known in the art of recombinant DNA technology may be routinely applied to select the desired recombinant clone, and such methods are described, for example, in Ausubel et al., eds., Current Protocols in Molecular Biology, John Wiley &t Sons (1993). The expression levels of an immunocytokine and/or cofactor can be increased by vector amplification. When a marker in the vector system expressing the immunocytokine and/or cofactor is amplifiable, an increase in the level of inhibitor present in the culture will increase the number of copies of the marker gene. Since the amplified region is associated with the gene encoding the immunocytokine and/or cofactor of interest, production of said immunocytokine will also increase (Crouse et al., *Mol Cell Biol* 3: 257, 1983). Alternative methods of expressing the gene of the invention exist and are known to the person of skills in the art. For example, a modified zinc finger protein can be engineered that is capable of binding the expression regulatory elements upstream of the gene of the invention; expression of the said engineered zinc finger protein (ZFN) in the host cell of the invention leads to increases in protein production (see e.g., Reik et al., *Biotechnol. Bioeng.*, 97(5), 1180-1189, 2006). Moreover, ZFN can stimulate the integration of a DNA into a predetermined genomic location, resulting in high-efficiency site-specific gene addition (Moehle et al, *Proc Natl Acad Sci USA* 104:3055, 2007).

The immunocytokine or the protein complex of the invention may be prepared by growing a culture of the transformed host cells under culture conditions necessary to express the desired antibody. The resulting expressed immunocytokine or protein complex may then be purified from the culture medium or cell extracts. Soluble forms of the immunocytokine or of the protein complex can be recovered from the culture supernatant. It may then be purified by any method known in the art for purification of an immunoglobulin molecule, for example, by chromatography (e.g., ion exchange, affinity, particularly by Protein A affinity for Fc, and so on), centrifugation, differential solubility or by any other standard technique for the purification of proteins. Suitable methods of purification will be apparent to a person of ordinary skills in the art.

Pharmaceutical Compositions

When addressed to the tumour site, the immunocytokines provided herein are cleaved, thus releasing a cytokine such as IL-15, which has anti-tumour activity. In addition, some of the antibody moieties are capable of inducing ADCC and/or CDC responses and/or have an intrinsic anti-tumour activity. It will thus be appreciated by the skilled person that the immunocytokines and the protein complexes provided herein are useful in the treatment of metastatic tumours and diseases such as cancer.

The terms "treating" or "treatment" refer to administering or the administration of a composition described herein in an amount, manner, and/or mode effective to improve a condition, symptom, or parameter associated with a disorder or to prevent progression or exacerbation of the disorder (including secondary damage caused by the disorder) to either a statistically significant degree or to a degree detectable to one skilled in the art.

Another aspect of the invention relates to pharmaceutical compositions of the immunocytokines described herein.

The pharmaceutical composition of the invention may contain, in addition to the immunocytokine of the invention, various diluents, fillers, salts, buffers, stabilizers, solubilisers, and other materials well known in the art.

As used herein, "pharmaceutically acceptable carrier" includes any and all solvents, buffers, salt solutions, dispersion media, coatings, antibacterial and antifungal agents, isotonic and absorption delaying agents, and the like that are physiologically compatible. The type of carrier can be selected based upon the intended route of administration. In various embodiments, the carrier is suitable for intravenous, intraperitoneal, subcutaneous, intramuscular, topical, transdermal or oral administration. Pharmaceutically acceptable carriers include sterile aqueous solutions or dispersions and sterile powders for the extemporaneous preparation of sterile injectable solutions or dispersion. The use of media and agents for pharmaceutically active substances is well known in the art. As detailed below, additional active compounds can also be incorporated into the compositions, such as anti-cancer and/or anti-angiogenesis agents; in particular, the additional active compound can be an anti-angiogenic agent, a chemotherapeutic agent, or a low-molecular weight agent. A typical pharmaceutical composition for intravenous infusion could be made up to contain 250 ml of sterile Ringer's solution, and 100 mg of the combination. Actual methods for preparing parenterally administrable compounds will be known or apparent to those skilled in the art and are described in more detail in for example, Remington's Pharmaceutical Science, 17th ed., Mack Publishing Company, Easton, Pa. (1985), and the $18^{th}$ and $19^{th}$ editions thereof, which are incorporated herein by reference.

The immunocytokine or the protein complex present in the composition preferably is formulated in an effective amount. An "effective amount" refers to an amount effective, at dosages and for periods of time necessary, to achieve the desired result, such as induction of apoptosis in tumour cells. A "therapeutically effective amount" means an amount sufficient to influence the therapeutic course of a particular disease state. A therapeutically effective amount is also one in which any toxic or detrimental effects of the agent are outweighed by the therapeutically beneficial effects.

For therapeutic applications, the immunocytokine or the protein complex is administered to a mammal, preferably a human, in a pharmaceutically acceptable dosage form such as those discussed above, including those that may be administered to a human intravenously as a bolus or by continuous infusion over a period of time, by intramuscular, intraperitoneal, intracerobrospinal, subcutaneous, intraarticular, intrasynovial, intrathecal, oral, topical, or inhalation routes. The immunocytokine or the protein complex is also suitably administered by intratumoral, peritumoral, intralesional, or perilesional routes, to exert local as well as systemic therapeutic effects. The intraperitoneal route is expected to be particularly useful, for example, in the treatment of ovarian tumours. Dosage regimens may be adjusted to provide the optimum response. For example, a single bolus may be administered, several divided doses may be administered over time, or the dose may be proportionally reduced or increased. One skilled in the art in the field of preparing formulations can readily select the proper form and mode of administration depending upon the particular characteristics of the product selected, the disease or condition to be treated, the stage of the disease or condition and other relevant circumstances The compositions of the invention can be administered to a subject to effect cell growth activity in a subject. As used herein, the term "subject" is intended to include living organisms in which apoptosis can be induced, and specifically includes mammals, such as rabbits, dogs, cats, mice, rats, monkey transgenic species thereof, and preferably humans.

The effectiveness of the immunocytokine or of the protein complex in preventing or treating cancer may be improved by administering said immunocytokine or protein complex serially or in combination with another agent that is effective for those purposes, such as tumour necrosis factor (TNF), an antagonist capable of inhibiting or neutralising the angiogenic activity of acidic or basic fibroblast growth factor (FGF), platelet-derived growth factor (PDGF), or hepatocyte growth factor (HGF), an antagonist capable of inhibiting or neutralising the coagulant activities of tissue factor, protein C, or protein S (see WO 91/01753), an antagonist such as an antibody capable of binding to HER2 receptor (see U.S. Pat. No. 5,772,997), or one or more conventional therapeutic agents such as, for example, alkylating agents, folic acid antagonists, anti-metabolites of nucleic acid metabolism, antibiotics, pyrimidine analogues, 5-fluorouracil, cisplatin, purine nucleosides, amines, amino acids, triazol nucleosides, or corticosteroids.

In addition, the pharmaceutical composition of the invention may also comprise another agent which is capable of modulating immune cell, notably T cell or monocyte, activation and/or function. In particular, the pharmaceutical composition of the invention may further comprise a therapeutically effective amount of an antagonist to a co-inhibitory molecule. In some embodiments, the co-inhibitory molecule is selected from the group consisting of CD86, CD80, PDL-1, PDL-2, CTLA-4, PD1, LAG3, BTNL2, B7-H3, B7-H4, a butyrophilin, CD48, CD244, TIM-3, CD200R, CD200, CD160, BTLA, HVEM, LAIR1, TIM1, Galectin 9, TIM3, CD48, 2B4, CD155, CD112, CD113 and TIGIT. The antagonist to the co-inhibitory molecule includes an antibody against the co-inhibitory molecule. It is recognised that antagonist to other co-inhibitory molecules are well known in the art, such as those described in Mercier et al., Frontiers in Immunology, 6:418 (2015), Kyi et al., FEBS Letters, 588:368-376 (2014) and Pardoll, Nature Reviews, 12:252-264 (2012). In some other embodiments, the pharmaceutical composition described herein further comprises a therapeutically effective amount of an agonist to a co-stimulatory molecule. In some embodiments, the co-stimulatory molecule is selected from the group consisting of CD154, TNFRSF25, GITR, 4-1BB, OX40, CD27, TMIGD2, ICOS, CD28, CD40, TL1A, GITRL, 41BBL, OX40L, CD70, HHLA2, ICOSL, a cytokine, LIGHT, HVEM, CD30, CD30L, B7-H2, CD80, CD86, CD40L, TIM4, TIM1, SLAM, CD48, CD58, CD155, CD112, DR3, GITR, CD2, and CD226. The agonist to the co-stimulatory molecule includes an agonistic antibody against the co-stimulatory molecule. It is recognised that agonists to co-stimulatory molecules are well known in the art, such as those described in Mercier et al., Frontiers in Immunology, 6:418 (2015), Kyi et al., FEBS Letters, 588:368-376 (2014) and Capece et al., J. Biomed. Biotechnol. 2012:926321, 17 pages (2012).

In another aspect of the invention, the administration is combined with an administration of therapeutically effective amount of chemotherapeutic agent, such as for example, taxol (paclitaxel) or taxotere (docetaxel).

Chemotherapeutic agents include without any Limitations, anti-microtubule agents such as diterpenoids and vinca alkaloids; platinum coordination complexes; alkylating agents such as nitrogen mustards, oxazaphosphorines, alkylsulfonates, nitrosoureas, and triazenes; antibiotic agents such as anthracyclines, actinomycins and bleomycins; topoisomerase II inhibitors such as epipodophyllotoxins; antimetabolites such as purine and pyrimidine analogues and antifolate compounds; topoisomerase I inhibitors such as camptothecins; hormones and hormonal analogues; signal transduction pathway inhibitors; non-receptor tyrosine kinase angiogenesis inhibitors; immunotherapeutic agents; proapoptotic agents; and cell cycle signalling inhibitors. In addition, the methods of the invention can be combined with another anti-cancer treatment, anti-angiogenic agent, or chemotherapeutic agent or radiation therapy. A preferred example is docetaxel or taxotere. Other examples include, gemcitabine, cisplatin diterpenoids and vinca alkaloids, paclitaxel, vinblastine, vincristine, and vinorelbine, carboplatin, cyclophosphamide, melphalan, and chlorambucil, busulfan, carmustine, dacarbazine, cyclophosphamide, melphalan, chlorambucil, busulfan, carmustine, dacarbazine, anti-neoplastic agents including, but not limited to, actinomycins such as dactinomycin, anthrocyclins such as daunorubicin and doxorubicin, bleomycins, epipodophyllotoxins, etoposide and teniposide; antimetabolite neoplastic agents, 5-fluorouracil, methotrexate, cytarabine, mecaptopurine, thioguanine, camptothecins, irinotecan HCl, and topotecan HCl.

A variety of different chemotherapeutic agents or anti-cancer polypeptides can also be selected. Information sources such as www.clinicaltrials.gov, www.ncbi.nlm.nih and www.drugs.com, include references to polypeptides and agents that can be selected.

Methods of Modulating an Immune Response

The immunocytokines and protein complexes provided herein can be used to modulate an immune response, since a cytokine is released when the linker is cleaved and may then activate specific immune cells. For example, IL-15 regulates the expansion of lymphocyte subsets; notably, IL-15 primarily stimulates the proliferation and cytotoxic functions of $CD8^+$ T cells and NK cells. Indeed, administration of the protein complex disclosed herein results in enhance proliferation of NK cells in the tumour microenvironment. In addition, the present immunocytokine is able to stimulate T cell activation in vivo when cleaved, but not in the uncleaved form.

The present disclosure thus relates to an immunocytokine disclosed herein or a pharmaceutical composition comprising said immunocytokine for use in stimulating an immune response in a subject.

The present disclosure also relates to a method for stimulating an immune response in a subject, comprising administering to the subject an immunocytokine disclosed herein or a pharmaceutical composition comprising said immunocytokine.

The present disclosure also relates to the protein complex disclosed herein or a pharmaceutical composition comprising said complex for use in stimulating an immune response in a subject.

The present disclosure also relates to a method for stimulating an immune response in a subject, comprising administering to the subject the protein complex disclosed herein or a pharmaceutical composition comprising said complex.

Also provided herein is the use of the immunocytokine or protein complex disclosed herein or a pharmaceutical composition comprising said immunocytokine or complex for making a medicament for stimulating an immune response in a subject.

The term "immune response" as used herein is meant to refer to the process whereby immune cells are stimulated and recruited from the blood to lymphoid as well as non-lymphoid tissues via a multifactorial process that involves distinct adhesive and activation steps. Activation conditions cause the release of cytokines, growth factors, chemokines and other factors, upregulate expression of adhesion and other activation molecules on the immune cells, promote adhesion, morphological changes, and/or extravasation concurrent with chemotaxis through the tissues, increase cell proliferation and cytotoxic activity, stimulate antigen presentation and provide other phenotypic changes including generation of memory cell types. Immune response if also meant to refer to the activity of immune cells to suppress or regulate inflammatory or cytotoxic activity of other immune cells. Exemplary immune responses include B cell responses (e.g., antibody production) T cell responses (e.g., cytokine production, and cellular cytotoxicity) and activation of cytokine responsive cells, e.g., NK cells and macrophages.

The immunocytokines described herein and protein complexes comprising these immunocytokines are useful to expand lymphocyte subsets, such as specific T/NK subsets. The present invention thus relates to the use of a product of the invention as an agent for expanding one or several lymphocyte populations, such as NK cells, NK-T cells, $CD8_+$ T cells, and to the adjuvants, compositions and kits intended for such a use, including the pharmaceutical compositions and drugs, which comprise at least one product of the invention.

The present disclosure thus relates to an immunocytokine disclosed herein or a pharmaceutical composition comprising said immunocytokine for use in stimulating an immune response in a mammal, wherein the immune response involves expanding one or several lymphocyte populations, such as NK cells, NK-T cells, $CD8^+$ T cells.

The present disclosure also relates to a method for stimulating an immune response in a mammal, wherein the immune response involves expanding one or several lymphocyte populations, such as NK cells, NK-T cells, $CD8^+$ T cells, the method comprising administering to the mammal an immunocytokine disclosed herein or a pharmaceutical composition comprising said immunocytokine.

The present disclosure also relates to the protein complex disclosed herein or a pharmaceutical composition comprising said complex for use in stimulating an immune response in a mammal, wherein the immune response involves expanding one or several lymphocyte populations, such as NK cells, NK-T cells, $CD8_+$ T cells.

The present disclosure also relates to a method for stimulating an immune response in a mammal, wherein the immune response involves expanding one or several lymphocyte populations, such as NK cells, NK-T cells, $CD8_+$ T cells, the method comprising administering to the mammal the protein complex disclosed herein or a pharmaceutical composition comprising said complex.

Activation of lymphocyte expansion by release of a cytokine such as, e.g., IL-15 from immunocytokines disclosed herein, or from protein complexes comprising such an immunocytokine, as a means of stimulating an immune response is useful in therapy.

Stimulation of immune responses can be in the form of enhancing an existing immune response or eliciting an initial immune response. For example, enhancing an immune response through activation of lymphocyte expansion is useful in cases of infections with microbes, e.g., bacteria, viruses, or parasites, or in cases of immunosuppression. Activation of lymphocyte expansion by release of a cytokine, e.g. IL-15, from an immunocytokine can also be useful in the treatment of tumour immunity. Tumour cells (e.g., colorectal cancer, sarcoma, melanoma, lymphoma, leukaemia, neuroblastoma, or carcinoma) can be contacted in vitro or in vivo with the present protein complex, thereby releasing the cytokine, e.g. IL-15, from said immunocytokine. If desired, the tumour cells can also be transfected with other polypeptides which stimulate immune responses (e.g., antibodies against immune checkpoints such as PD-1, PD-L1, or VISTA).

Methods of Treatment

The immunocytokine, the protein complexes, and the pharmaceutical compositions of the invention are especially useful in the treatment or prevention of several types of cancers.

Another aspect of the invention thus relates to the immunocytokine described herein for use in the treatment of cancer.

The invention also relates to a pharmaceutical composition comprising the immunocytokine described herein for use in the treatment of cancer.

The invention also relates to a protein complex described herein for use in the treatment of cancer.

The invention also relates to a pharmaceutical composition comprising the protein complex described herein for use in the treatment of cancer.

In another embodiment, the invention relates to a method of treatment of cancer, comprising administering to a subject in need thereof a therapeutically effective amount of an immunocytokine described herein.

In another embodiment, the invention relates to a method of treatment of cancer, comprising administering to a subject in need thereof a pharmaceutical composition comprising a therapeutically effective amount of an immunocytokine described herein.

In another embodiment, the invention relates to a method of treatment of cancer, comprising administering to a subject in need thereof a therapeutically effective amount of a protein complex described herein.

In another embodiment, the invention relates to a method of treatment of cancer, comprising administering to a subject in need thereof a pharmaceutical composition comprising a therapeutically effective amount of a protein complex described herein.

The cancers which may be treated by the present immunocytokines are cancers in which the antigen recognised by the antibody moiety of said immunocytokines is expressed. These cancers include (but not limited to) the following: carcinomas and adenocarcinomas, including that of the bladder, breast, colon, head-and-neck, prostate, kidney, liver, lung, ovary, pancreas, stomach, cervix, thyroid and skin, and including squamous cell carcinoma; hematopoietic tumours of lymphoid lineage, including multiple myeloma, leukaemia, acute and chronic lymphocytic (or lymphoid) leukaemia, acute and chronic lymphoblastic leukaemia, B-cell lymphoma, T-cell lymphoma, non-Hodgkin lymphoma (e.g. Burkitt's lymphoma); hematopoietic tumours of myeloid lineage, including acute and chronic myelogenous (myeloid or myelocytic) leukaemia, and promyelocytic leukaemia; tumours of mesenchymal origin, including fibrosarcoma, osteosarcoma and rhabdomyosarcoma; tumours of the central and peripheral nervous system, including astrocytoma, neuroblastoma, glioma, and schwannomas; and other tumours, including melanoma, teratocarcinoma, xeroderma pigmentosum, keratoacanthoma, and seminoma, and other cancers yet to be determined in which said antigen is expressed. By cancers in which the antigen recognised by the antibody moiety of said immunocytokine is expressed, it is herein referred to cancers displaying high expression of said antigen, relative to the expression level of said antigen on a normal adult cell.

Other agents described above, e.g. anti-angiogenic agents or chemotherapeutic agents may be present in the composition being administered or may be administered separately. In one aspect of the invention, the administration is performed with the other active principle, either simultaneously, separately or sequentially over time. When the administration is performed simultaneously, the two active principles may be combined in a single pharmaceutical composition, comprising the two compositions, such as a tablet or a gel capsule. On the other hand, the two active principles may, whether or not they are administered simultaneously, be present in separate pharmaceutical compositions. To this end, the combination may be in the form of a kit comprising, on the one hand, the immunocytokine described herein or a protein complex comprising this immunocytokine, and, on the other hand, the second active principle, the immunocytokine or protein complex described herein and the second active principle being in separate compartments and being intended to be administered simultaneously, separately, or sequentially over time.

The present combination can be administered especially for treating cancer in combination with chemotherapy, protein therapy (i.e., using a therapeutic agent such as an antibody or recombinant protein), gene therapy, radiotherapy, immunotherapy, surgical intervention, or a combination of these. Long-term therapy is equally possible as is adjuvant therapy in the context of other treatment strategies, as described above.

Cytokines such as IL-15 are capable of stimulating tumour-specific T cell responses that are highly-specific. For example, administration of IL-15 induces the selective activation and proliferation in CD8 T cells and NK cells, the very cell types most amenable to mediating anti-tumour responses (Waldmann, *J Invest Dermatol Symp Proc.* 16(1): S28-30, 2013).

In some embodiments, the immunocytokine can be used in a method of modulating Immune cell function, mediated by binding of the cytokine moiety, preferably IL-15, of said immunocytokine. Preferably, said immune cell is a T cell or a monocyte. Such methods can include contacting the immune cell, preferably a T cell or a monocyte, with the immunocytokine described herein. In some embodiments, the method for modulating the immune cell (notably T cell or monocyte) function includes administering an effective amount of a composition comprising an immunocytokine provided herein to a subject. In some aspects, the T cell function that is modulated includes increasing T cell activation. Such T cell activation can further include increasing T cell proliferation. In some aspects, the monocyte function that is modulated includes increasing secretion of anti-cancer cytokines. Methods for assaying the modulation of an immune response are well known to one of skill in the art, and it is understood that a skilled artisan would be able to readily conduct such assays.

In some embodiments, an immunocytokine or a composition comprising an immunocytokine as described herein can be used either alone or in combination with another compound or treatment. For example, in some embodiments, the other compound is an antagonist to a co-inhibitory molecule or an agonist to a co-stimulatory molecule. In such embodiments, the combined therapy leads to reinvigoration or de novo activation of the immune system through activated T cells that is greater than the administration of either compound or treatment individually. This activation of the immune system will result in a highly beneficial physiological response in the treatment of cancer.

In some embodiments, a protein complex or a composition comprising this complex as described herein can be used either alone or in combination with another compound or treatment. For example, in some embodiments, the other compound is an antagonist to a co-inhibitory molecule or an agonist to a co-stimulatory molecule. In such embodiments, the combined therapy leads to reinvigoration or de novo activation of the immune system through activated T cells that is greater than the administration of either compound or treatment individually. This activation of the immune system will result in a highly beneficial physiological response in the treatment of cancer.

In some embodiments, the methods described herein can include administering a therapeutically effective amount of an immunocytokine in combination with a therapeutically effective amount of an antagonist to a co-inhibitory molecule. In some embodiments, the co-inhibitory molecule is selected from the group consisting of CD86, CD80, PDL-1, PDL-2, CTLA-4, PD1, LAG3, BTNL2, B7-H3, B7-H4, a butyrophilin, CD48, CD244, TIM-3, CD200R, CD200, CD160, BTLA, HVEM, LAIR1, TIM1, Galectin 9, TIM3, CD48, 2B4, CD155, CD112, CD113 and TIGIT. The antagonist to the co-inhibitory molecule includes an antibody against the co-inhibitory molecule. It is recognised that antagonist to other co-inhibitory molecules are well known in the art, such as those described in Mercier et al., Frontiers in Immunology, 6:418 (2015), Kyi et al., FEBS Letters, 588:368-376 (2014) and Pardoll, Nature Reviews, 12:252-264 (2012). According to this embodiment, the invention relates to an immunocytokine for use in treatment of cancer as described above, said use further comprising the administration of an antagonist to a co-inhibitory molecule, wherein said co-inhibitory molecule is selected from the group consisting of CD86, CD80, PDL-1, PDL-2, CTLA-4, PD1, LAG3, BTNL2, B7-H3, B7-H4, a butyrophilin, CD48, CD244, TIM-3, CD200R, CD200, CD160, BTLA, HVEM, LAIR1, TIM1, Galectin 9, TIM3, CD48, 2B4, CD155, CD112, CD113 and TIGIT.

In some embodiments, the methods described herein can include administering a therapeutically effective amount of an immunocytokine in combination with a therapeutically effective amount of an agonist to a co-stimulatory molecule. In some embodiments, the co-stimulatory molecule is selected from the group consisting of CD154, TNFRSF25, GITR, 4-1BB, OX40, CD27, TMIGD2, ICOS, CD28, CD40, TL1A, GITRL, 41BBL, OX40L, CD70, HHLA2, ICOSL, a cytokine, LIGHT, HVEM, CD30, CD30L, B7-H2, CD80, CD86, CD40L, TIM4, TIM1, SLAM, CD48, CD58, CD155, CD112, DR3, GITR, CD2, and CD226. The agonist to the co-stimulatory molecule includes an agonistic antibody against the co-stimulatory molecule. It is recognised that agonists to co-stimulatory molecules are well known in the art, such as those described in Mercier et al., Frontiers in Immunology, 6:418 (2015), Kyi et al., *FEBS Letters*, 588: 368-376 (2014) and Capece et al., *J. Biomed. Biotechnol.* 2012:926321, 17 pages (2012). According to this embodiment, the invention relates to an immunocytokine for use in treatment of cancer as described above, said use further comprising the administration of an agonist to a co-stimulatory molecule, wherein said co-stimulatory molecule is selected from the group consisting of CD154, TNFRSF25, GITR, 4-1BB, OX40, CD27, TMIGD2, ICOS, CD28, CD40, TL1A, GITRL, 41BBL, OX40L, CD70, HHLA2, ICOSL, a cytokine, LIGHT, HVEM, CD30, CD30L, B7-12, CD80, CD86, CD40L, TIM4, TIM1, SLAM, CD48, CD58, CD155, CD112, DR3, GITR, CD2, and CD226.

The examples that follow are merely exemplary of the scope of this invention and content of this disclosure. One skilled in the art can devise and construct numerous modifications to the examples listed below without departing from the scope of this invention.

EXAMPLES

Example 1: Sequences of the Constructions

1. Sequences

TABLE 1

Antibodies variable regions.

| SEQ ID NO: | HC (variable region): DNA | HC (variable region): protein | LC (variable region): DNA | HC (variable region): protein |
|---|---|---|---|---|
| Anti-PDL1 | 1 | 2 | 3 | 4 |
| H16/L16 | 5 | 6 | 7 | 8 |
| NHS76 | 9 | 10 | 11 | 12 |
| C9G4 | 13 | 14 | 15 | 16 |

TABLE 2

Constant regions.

| SEQ ID NO: | DNA | Protein |
|---|---|---|
| Human IgG1Δκ | 17 | 18 |
| Human IgG4Δκ | 19 | 20 |
| Human Kappa constant | 21 | 22 |
| Human Lambda constant | 23 | 24 |

Similar results were obtained with a human IgG1 instead of a human IgG1ΔK.

TABLE 3

Full-length antibody chains

| SEQ ID NO: | Light chain: full-length DNA | Light chain: full-length Protein | Heavy chain: full-length DNA | Heavy chain: full-length Protein |
|---|---|---|---|---|
| hH16L16_LhK | 53 | 54 | | |
| m9g4_LhK | 187 | 188 | | |
| hNHS76_LhL | 55 | 56 | | |
| hH16L16_IgG1dK | | | 189 | 190 |
| hH16L16_IgG4PdK | | | 191 | 192 |
| m9G4_IgG1dK | | | 193 | 194 |
| m9G4_IgG4PdK | | | 195 | 196 |
| hNHS76_IgG1dK | | | 197 | 198 |
| hNHS76_IgG4PdK | | | 199 | 200 |

TABLE 4

Cytokines.

| SEQ ID NO: | DNA | Protein |
|---|---|---|
| Human IL-15 | 25 | 26 |
| Human IL-2 | 27 | 28 |
| Human CCL4 | 29 | 30 |
| Human INFα2a | 31 | 32 |
| NanoLuc ® | 33 | 34 |
| Human IL-36γ | 171 | 172 |

TABLE 5

Linkers.

| SEQ ID NO: | DNA | Protein |
|---|---|---|
| L1 | 35 | 36 |
| L2 | 37 | 38 |
| L3 | 39 | 40 |
| L4 | 41 | 42 |
| L5 | 43 | 44 |
| L6 | 45 | 46 |
| L7 | 165 | 166 |
| L8 | 167 | 168 |
| L9 | 169 | 170 |
| L6-L6 | 201 | 202 |
| Nc30 | 203 | 204 |

TABLE 6

Cloning sites (for some NanoLuc ® constructions, two amino acids were added to create a new and necessary restriction site).

| SEQ ID NO: | DNA | Protein |
|---|---|---|
| Cloning site | 47 | 48 |

TABLE 7

Cofactors

| SEQ ID NO: | Cofactors DNA | Cofactors Protein |
|---|---|---|
| sushi | 205 | 206 |
| sushi+ | 207 | 208 |
| sIL-15Rα | 209 | 210 |

TABLE 8

ICC.

| SEQ ID NO: | DNA | Protein |
|---|---|---|
| HC: H16/L16-PVGLIG-IL-15 | 49 | 50 |
| HC: NHS76-PVGLIG-hIL-15 | 51 | 52 |
| H16/L16-PVGLIG-hIL-15 | HC: 49 | HC: 50 |
|  | LC: 53 | LC: 54 |
| NHS76-PVGLIG-hIL-15 | HC: 51 | HC: 52 |
|  | LC: 55 | LC: 56 |

TABLE 8

ICC - full constructs.

| SEQ ID NO: | | DNA | Protein |
|---|---|---|---|
| Single linker | | | |
| PDL1-GPLGMLSQ-NanoLuc | C-term HC | 57 | 58 |
|  | C-term LC | 59 | 60 |
|  | N-term HC | 61 | 62 |
|  | N-term LC | 63 | 64 |
| PD-L1-GPLGMLSQ-I | C-term HC | 65 | 66 |
|  | C-term LC | 67 | 68 |
|  | N-term HC | 69 | 70 |
|  | N-term LC | 71 | 72 |
| PD-L1-GPLGIAGQ-NanoLuc | C-term HC | 73 | 74 |
|  | C-term LC | 75 | 76 |
|  | N-term HC | 77 | 78 |
|  | N-term LC | 79 | 80 |
| PD-L1-GPLGIAGQ-IL-2 | C-term HC | 81 | 82 |
|  | C-term LC | 83 | 84 |
|  | N-term HC | 85 | 86 |
|  | N-term LC | 87 | 88 |
| PD-L1-GPLGLWAQ-NanoLuc | C-term HC | 89 | 90 |
|  | C-term LC | 91 | 92 |
|  | N-term HC | 93 | 94 |
|  | N-term LC | 95 | 96 |
| PD-L1-GPLGLWAQ-IL-2 | C-term HC | 97 | 98 |
|  | C-term LC | 99 | 100 |
|  | N-term HC | 101 | 102 |
|  | N-term LC | 103 | 104 |
| PD-L1-PVGLIG-NanoLuc | C-term HC | 105 | 106 |
|  | C-term LC | 107 | 108 |
|  | N-term HC | 109 | 110 |
|  | N-term LC | 111 | 112 |
| PD-L1-PVGLIG-IL-2 | C-term HC | 113 | 114 |
|  | C-term LC | 115 | 116 |
|  | N-term HC | 117 | 118 |
|  | N-term LC | 119 | 120 |
| PD-L1-PLGLAG-NanoLuc | C-term HC | 121 | 122 |
|  | C-term LC | 123 | 124 |
|  | N-term HC | 125 | 126 |
|  | N-term LC | 127 | 128 |
| PD-L1-PLGLAG-IL-2 | C-term HC | 129 | 130 |
|  | C-term LC | 131 | 132 |
|  | N-term HC | 133 | 134 |
|  | N-term LC | 135 | 136 |
| PD-L1-GIVGPL-NanoLuc | C-term HC | 137 | 138 |
|  | C-term LC | 139 | 140 |
|  | N-term HC | 141 | 142 |
|  | N-term LC | 143 | 144 |
| PD-L1-GIVGPL-IL-2 | C-term HC | 145 | 146 |
|  | C-term LC | 147 | 148 |
|  | N-term HC | 149 | 150 |
|  | N-term LC | 151 | 152 |
| 9G4-PVGLIG-NanoLuc | C-term HC | 153 | 154 |
| 9G4-PVGLIG-CCL4 | C-term HC | 155 | 156 |
| 9G4_HhG1dK_L6_IL-15 | C-term HC | 157 | 158 |
| 9G4_HhG4PdK_L6_IL-15 | C-term HC | 213 | 214 |
| 9G4-PVGLIG-IFNα | C-term HC | 159 | 160 |
| hNHS76_HhG1dK_L6_IL-15 | C-term HC | 161 | 162 |
| hNHS76_HhG4PdK_L6_IL-15 | C-term HC | 215 | 216 |
| hH16L16_HhG1dK_L6_IL-15IL-15 | C-term HC | 163 | 164 |
| hH16L16_HhG4PdK_L6_IL-15IL-15 | C-term HC | 211 | 212 |
| H16/L16-PVGLIG-IL-36G heavy chain | C-term HC | 173 | 174 |

TABLE 8-continued

ICC - full constructs.

| SEQ ID NO: | | DNA | Protein |
|---|---|---|---|
| 9G4-SGRS-hCXCL10 heavy chain | C-term HC | 175 | 176 |
| NHS76-SGRS-hCXCL10 heavy chain | C-term HC | 177 | 178 |
| H16L16-SGRS-hCXCL10 heavy chain | C-term HC | 179 | 180 |
| H16L16-SGRS-hIL-15 heavy chain | C-term HC | 181 | 182 |
| H16L16-SGRSA-hIFNa heavy chain | C-term HC | 183 | 184 |
| H16L16-PSSRRRVN-hIFNa heavy chain | C-term HC | 185 | 186 |
| hH16L16_HhG1dK_SGRSA_IL-15 | C-term HC | 217 | 218 |
| Double linker | | | |
| hH16L16_HhG1dK_L6-L6_IL-15 | C-term HC | 219 | 220 |
| hH16L16_HhG4PdK_L6-L6_IL-15 | C-term HC | 221 | 222 |
| m9G4_HhG1dK_L6_L6_IL-15 | C-term HC | 223 | 224 |
| m9G4_HhG4PdK_L6_L6_IL-15 | C-term HC | 225 | 226 |
| hNHS76_HhG1dK_L6-L6_IL-15 | C-term HC | 227 | 228 |
| hNHS76_HhG4PdK_L6-L6_IL-15 | C-term HC | 229 | 230 |

TABLE 9

Protein fusion of ICC and sushi or sushi+

| | C-term Heavy Chain - cytokine | |
|---|---|---|
| SEQ ID NO: | DNA | Protein |
| Single linker | | |
| hH16L16_HhG1dK_L6_IL-15[nc30-sushi] | 231 | 232 |
| hH16L16_HhG4PdK_L6_IL-15[nc30-sushi] | 233 | 234 |
| hH16L16_HhG1dK_PVGLIG_IL-15[nc30-sushi+] | 235 | 236 |
| hH16L16_HhG4PdK_PVGLIG_IL-15[nc30-sushi+] | 237 | 238 |
| Double linker | | |
| hH16L16_HhG1dK_L6L6_IL-15[nc30-sushi] | 239 | 240 |
| hH16L16_HhG1dK_L6-L6_IL-15[nc30-sushi+] | 241 | 242 |

1.2. Obtention of the Immunocytokines (ICC)

Sequences coding for the whole ICC (see point 1. Sequences) were cloned into pCDNA3.4 vectors by using the H-indIII/BamHI restriction sites, including a signal peptide (Thermo Fisher Scientific). The NanoLuc® DNA sequence was obtained from Promega. Linker modification was achieved by Q5 mutagenesis (New England Biolabs). Fusion proteins were obtained by transient protein expression in Expi HEK293 cells (Thermo Fisher Scientific) grown to a density of 2.5 $10^6$/ml in Expi293 Expression Medium (Thermo Fisher Scientific) and co-transfected with 1.25 µg/ml DNA (HC/LC: 1/1 w/w) using polyethyleneimine (PEI, Polyscience, DNA/PEI ratio: 1/4). 2 mM valproic acid (VPA, Sigma-Aldrich) was then added 3 hours post transfection. Supernatants containing the produced fusion proteins were harvested 6 days post-transfection. Proteins were purified by affinity chromatography on Protein A-Sepharose and formulated by overnight dialysis against 25 mM sodium citrate, 150 mM NaCl, 6% Saccharose pH 5.5. Some of the constructions realised are resumed in FIG. 1.

The positions (i.e., the fusion sites) of the linker-cytokine on the Ab are explained on FIG. 2.

Example 2: Proof of Immunocytokines Formation and Integrity by LC-MS Analysis 2.1. Material and Methods All the purified ICC were characterised by SDS-PAGE in non-reducing, heated conditions and in reducing and heated condition. The SDS-PAGE migration of c9G4-PVGLIG-hIL-15, NHS76-PVGLIG-hIL-15 and H16/L16-PVGLIG-hIL-15 are shown in FIG. 22. The apparent ICC molecular weights deduced from the SDS PAGE were in accordance of what was expected with theoretical calculations. At least of 80% for each ICC were complete ICC (H2L2). The monomeric content of ICC was determined by Size Exclusion Chromatography.

ICC integrity was also verified by LC-MS on glycosylated ICC and on deglycosylated ICC after IdeS digestion. Reverse phase separation was performed on an ultra-high-performance liquid chromatography (UHPLC) system (Acquity UPLC H-Class Bio system, Waters) coupled to a Synapt G2si mass spectrometer, instrument control was performed using MassLynx® software (Waters).

For c9G4PVGLIG-IL-15, c9G4PVGLIG-hINFa, c9G4PVGLIG-hCCL4, deglycosylation of the Fc region was performed by incubating ICC solution 30 min at 37° C. with IgGZERO® Enzyme (Genovis) at the concentration of 1 unit of enzyme per μg of ICC according with the manufacturer's instructions. For NHS76-PVGLIG-hIL-15 and H16L16-PVGLIG-hIL-15 which carry out N-glycosylation on the IL-15 part, deglycosylation was performed by adding 2 μL of PNGaseF (New England Biolabs, 500 000 U/mL) and 2 μL of neuraminidase (New England Biolabs, 50 000 U/mL) to 25 μg of sample solution followed by incubation at 37° C. overnight. The deglycosylated ICC were injected on a zorbax diphenyl column (Agilent) heated at 80° C. Elution was performed with water as eluent A and acetonitrile as eluent B, both containing 0.1% FA and 0.02 TFA. The gradient condition was maintained at 30% B for 0.5 min, ramped to 46.9% in 6.5 min and increased to 95% in 0.1 min.

Subunit Fc/2 fragments were obtained by incubating ICC solution during 30 minutes at 37° C. with IdeS enzyme (FabRICATOR®, Genovis) at the concentration of 1 Unit of enzyme per μg of ICC according to the manufacturer's instructions. Deglycosylated and digested ICC were injected on a PLRP-S column (Agilent) heated at 80° C. Elution was performed with water as eluent A and acetonitrile as eluent B, both containing 0.05% TFA. The gradient condition was maintained at 5% B for 5 min, ramped to 50% in 45 min and increased to 95% in 2 min 2.2. Results On MS chromatogram peaks, m/z spectrum was extracted and mass determined after m/z spectrum deconvolution and calculated masses of deglycosylated ICC and deglycosylated fc/2 were compared with experimental masses.

The LS-MS analysis of deglycosylated c9G4-PVGLIG-hIL-15, NHS76-PVGLIG-hIL-15 and H16/L16-PVGLIG-hIL-15 immunocytokines is represented in (FIG. 2 and FIG. 3). The pattern is consistent with what was expected for a fully formed ICC, as shown in Table 8:

TABLE 8

C-term HC ICC: Comparison of experimental vs. theoretical masses of ICC and Fc/2.

| | ICC | | Subunit: c9G4-Fc/2 + Cytokine | |
|---|---|---|---|---|
| | Calculated MW (Da) | Experimental MW (Da) | Calculated MW (Da) | Experimental MW (Da) |
| C9G4-PVGLIG-hIL-15 | 171746 | 171760 | 37076 | 37081 |
| C9G4-PVGLIG-hINFa | 158378 | 158379 | 43892 | 43892 |
| C9G4-PVGLIG-hCCL4 | 164725 | 164727 | 32470 | 32469 |

| | ICC | | Subunits: NHS76 or H16/L16-Fc/2 + Cytokine | |
|---|---|---|---|---|
| | Calculated MW (Da) | Experimental MW (Da) | Calculated MW (Da) | Experimental MW (Da) |
| NHS76-PVGLIG-hIL-15 | 169559 | 169566 | 37084 | 37085 |
| H16/L16-PVGLIG-hIL-15 | 172120 | 172138 | 37084 | 37083 |

Whole experimental masses confirmed the ICC structures (2 cytokines/antibody) and Fc/2+Cytokine masses confirmed the cytokine position.

Similar experiments were performed and similar conclusions were obtained for other ICCs.

Example 3: Linker Sequences and Cleavability by MMP-9/2

Five linkers from the literature were evaluated as substrates for MMP-9 when fused to four different sites on the PDL1 Ab sequence: N-term HC, N-term LC, C-term HC and C-term LC. The 'GIVGPL' linker described as non-cleavable (Chau et al. Bioconjug Chem (2004) 15(4):931-41) was used as negative control. The summary of the constructions and results are displayed in FIG. 7.

3.1. Materials and Methods

2 μg of purified ICC were incubated in presence of 40 ng recombinant MMP-9 or MMP-2 (molar ratio 25:1) in assay buffer containing 20 mM Tris pH 7.5, 10 mM $CaCl_2$ and 100 mM NaCl in 20 μL total volume. Samples were incubated at 30° C. for 2.5 hrs under gentle agitation (300 rpm). Cleavage reaction was stopped by addition of loading buffer+reducing agent (4× XT sample Buffer and 20×Reducing Agent, Bio-Rad) and sample heating at 90° C. for 5 min.

Cleavage efficiency was then evaluated by SDS-PAGE. 20 μl of sample were run onto Criterion TGX 4-15% Stain Free gels (BioRad) in Tris-Glycine-SDS buffer (BioRad) at 300 V for 20 min with protein standards (Precision Plus Protein Standards, Unstained, BioRad). Protein bands were then revealed using a ChemiDoc Touch Imager (BioRad).

3.2. Results 3.2.1. Cleavability with different linkers in HC or LC C-terminal fusions of anti-PDL1 antibodies and two different molecules: IL-2 and NanoLuc®:

The results are shown in FIG. 4

3.2.2. Cleavability with different linkers in HC or LC N-terminal fusions of anti-PDL1 antibodies and two different molecules: IL-2 and NanoLuc®:

The results are shown in FIG. 5.

3.2.3. Cleavability of different c9G4-based ICC and H16/L16-IL-15 and HHS76-IL-15 ICC by human and murine MMP-9/2 (HC C-term fusions and PVGLIG linker). The results are shown in FIG. 6.

Note 1: IL-15 and IFNa visualisation post-cleavage in impaired by the high level of glycosylation of the proteins. Sample deglycosylation prior cleavage allows the visualisation of the released cytokines, indicating the proteins are not proteolysed by MMP-9/2 (data not shown).

3.3. Conclusion

Results of FIGS. 4, 5 and 6 are summarized in FIG. 7. Two fusions sites were identified, which allowed correct cleavage by the protease: N-term and C-term of the Ab heavy chain.

On the other hand, MMP-9 linkers were only weakly cleaved by either MMP-2 or MMP-9 when fused on N-term or C-term of the Ab light chains.

All five c9G4-fusion proteins are cleaved by murine and human MMP-9 and MMP-2 (FIG. 6).

Example 4: Analysis of the MMP-9 In Vitro Stability by LC-MS

4.1. Materials and Methods

ICC were spiked in buffer (50 mM Tris pH7.5, 150 mM NaCl, 20 mM CaCl2)), sera, plasma, and fresh blood at a concentration of 100 µg/ml with and without 12 nM MMP-9. Aliquots of 100 µl were incubated at +37° C. in Protein LoBind Tube (Eppendorf). After 24 hrs samples were removed from the oven and stored at −80° C. until sample processing and analysis.

The ICC was immunoprecipitated from biological fluid by immunoprecipitation using M280 streptavidin magnetics beads coated with 4 µg of CaptureSelect™ human IgG-Fc Biotin. After washing, ICC was eluted with 0.4% TFA in water and freeze drying. The samples were reconstituted in denaturing buffer (6 M Guanidine, 0.1 M Tris, 2 mM EDTA pH 8.0) and reduced in presence of DTT for 45 min at 56° C. Acetic acid was then added to quench the reaction and samples were analysed by LC-MS.

Reverse phase separation was performed on an ultra-high-performance liquid chromatography (UHPLC) system (Acquity UPLC H-Class Bio system, Waters) coupled to a Synapt G2si mass spectrometer, instrument control was performed using MassLynx® software (Waters).

The reduced samples were diluted volume to volume with eluent A and injected on a PLRP-S column heated at 80° C. with a flow rate of 0.5 mL/min. Elution was performed with water as eluent A and acetonitrile as eluent B, both containing 0.05% TFA. The gradient condition was maintained at 5% B for 5 min, ramped to 70% in 45 min and increased to 95% in 2 min.

For each peak of MS chromatogram, m/z spectrum was extracted and mass determined after m/z spectrum deconvolution.

4.2. Results 4.2.1 Validation of MMP-9 Cleavage Site in ICC.

In MMP-9 absence, no cleaved fragments were observed for both anti-PDL1-PVGLIG-NanoLuc® and anti-PDL1-GIVGPL-NanoLuc®, thus both linkers were stable in buffer at the concentration of 12 nM.

Cleavage in presence of MMP-9 was checked by LC/MS as described in Example 2. The results are shown in FIGS. 8 A and B.

In the presence of MMP-9, 100% of antibody anti-PDL1-PVGLIG-NanoLuc® were cleaved in buffer after 24 hrs at 37° C. (FIG. 8A). In fact, in FIG. 8A, the peak observed at 29.47 min which corresponds to the heavy chain of the anti-PDL1 antibody linked to a fragment of the PVGLIG linker (PVG). In comparison, no such a fragment is observed in FIG. 8B where the major signal corresponds to the full heavy chain of the anti-PDL1 antibody linked to the GIVGPL linker and NanoLuc®. MMP-9 is thus unable to cleave the GIVGPL peptide as opposed to PVGLIG peptide.

4.2.2. MMP-9 Cleavage in Sera, Plasma and Fresh Blood

Figure 9:
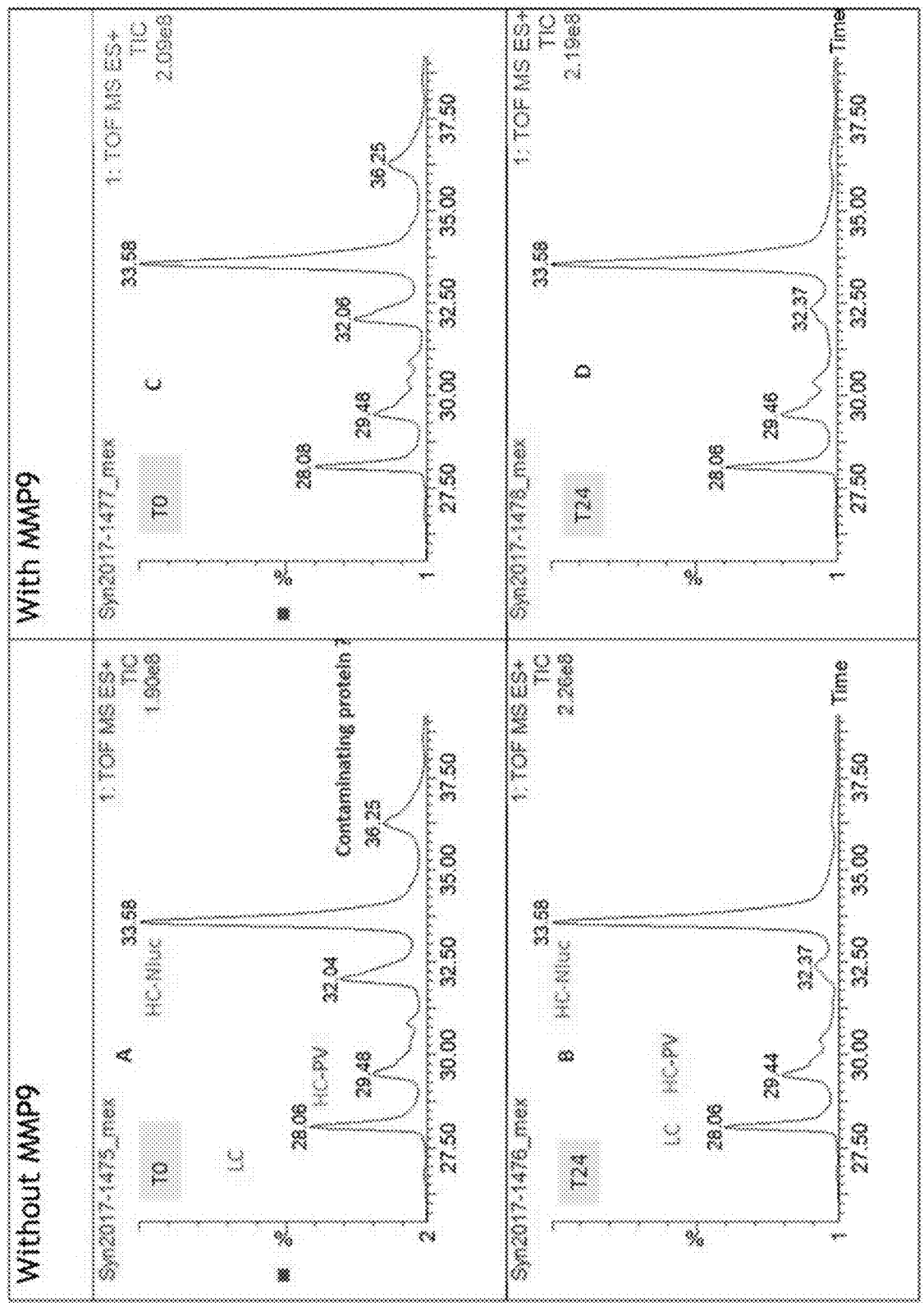

The results are shown in FIG. 9. With or without MMP-9 spiking, similar profiles were obtained at T0 and T24 in mouse heparin plasma, in mouse, cynomolgus, human sera and in whole mouse heparin blood. MMP-9 was inhibited in all the biological fluids tested, LC-MS profiles example presented in FIG. 9.

In conclusion, monitoring of In vitro antibody anti-PDL1 hkappa/hIgG4-PVGLIG-NanoLuc® cleavage was not possible in plasma heparin, sera and whole heparin blood (data not shown), probably because MMP-9 was inhibited. In fact, MMP-9 is known to be naturally attenuated in serum, plasma and blood, notably because of the presence of protease inhibitors like A2M.

Example 5: Attenuation of hIL-15 when Fused to an Antibody

In order to evaluate and to compare the biological activity of hIL-15, when linked to the ICC or after cleavage by MMP9, a test of IL-15 receptor dimerisation was performed. IL-15 in its active form signals through the dimerisation of its two receptor subunits IL-2Rβ/IL-2Rγ.

5.1. Materials and Methods 5.1.1. Materials and Reagents

Recombinant human recombinant pro-MMP-9 was purchased from R&D Systems and activated by 1 mM 4-Aminophenylmercuric acetate (APMA) in buffer containing 50 mM Tris, 150 mM NaCl, 10 mM CaCl2), 0.05% Brij-35 (w/v), pH7.5. APMA was then removed using Zeba™ Spin Desalting Columns (ThermoFisher Scientific) and APMA-free MMP-9 was immediately stored at −80° C. until needed. Recombinant human IL-15 was purchased from PeproTech. IL-15 activity was monitored using the PathHunter® U2OS IL-2Rβ/IL-2Rγ/(IL-2Rα) Dimerisation Bioassay (DiscoverX, Eurofins). The assay allows the detection of the IL-15-induced dimerisation of the two receptor subunits IL-2Rβ and IL-2Rγ.

5.1.2. Methods

The activity of three IL-15-based immunocytokines was assessed: NHS76-PVGLIG-hIL-15, H16/L16-PVGLIG-hIL-15 and c9G4-PVGLIG-hIL-15. The effect of recombinant hIL-15 and hMMP-9 was also evaluated using the same procedure. All samples were incubated for two hours in presence (+MMP-9) or absence (−MMP-9) of recombinant hMMP-9 in an assay buffer containing 50 mM Tris, 150 mM NaCl, 10 mM CaCl2) pH 7.5. Cleavage efficiency was controlled by SDS-PAGE analysis and samples were immediately stored at −20° C. until processing. U20S IL-2Rβ/IL-2Rγ/IL-2Rα cells were treated by either cleaved or uncleaved ICC and controls for 6 hours. Detection reagent was then added and chemiluminescence intensity was recorded with a microplate reader (Infinite M1000Pro, Tecan). Data analysis was performed with the Prism 7.01 software (GraphPad).

5.2. Results

The results of the hIL-15 induced receptor dimerisation for the three tested ICC are presented in FIG. 10 as function of the hIL-15 concentration.

The $EC_{50}$ of each compound or ICC are shown in Table 9.

As seen in FIG. 10 and Table 9, hIL-15 and hIL-15+MMP-9 highly induce receptor dimerisation and thus validate the experiment. On the contrary MMP-9 alone has no effect on IL-2Rβ/IL-2Rγ dimerisation as expected.

In the absence of MMP-9, the three evaluated ICC had no significant activity on receptor dimerisation. On the other hand, pre-treatment of the same molecules with MMP-9 results in activity recovery through IL-15-induced receptor dimerisation in a dose dependent manner.

It appears thus clearly from these experiments that IL-15 shows a highly attenuated activity when linked to the three antibodies. After cleavage of the ICC by MMP-9, IL-15 is liberated in its active form and is again able to fulfil its biological activity.

collected in 96 well U bottomed plates. Plasma samples were frozen (−80° C.) prior to analysis.

6.1.3. Tumour Samples

Tumours were sampled and snap frozen in liquid nitrogen and were stored at −80° C.

Prior to evaluation, the tumours are "resuspended" in 50 mM Tris-HCL buffer, 150 mM NaCl, 0.5% DOC, 1% Igepal, 1% Triton X100 containing an inhibitor cocktail (lysis buffer) at 200 mg of tumour per ml of buffer.

The tumours are disrupted with Minilys by 3 cycles of agitation at 5000 rpm in the presence of steel balls for 15 seconds. Between 2 cycles the tubes are kept on ice for 2 min. The solution is placed in a 2 ml conical Eppendorf tube and centrifuged at 11500 g at 4° C. for 10 min. The supernatant, i.e., the cell lysate, is recovered. Its protein content is measured by Bicinconinic Acid assay according to the manufacturer's instructions.

6.1.4. Western Blot Analysis

Serum samples as well as tumour samples were analysed by Western Blot. For each in vivo experiment the Western blots were done in triplicates.

Briefly, samples to be analysed are loaded on precast 4-15% polyacrylamide gel, at a rate of 0.1 μl for the plasma samples and 2 μl for the tumour lysates. Samples are migrated under heated, non-reduced conditions. Proteins are then transferred on nitrocellulose membranes using Trans-Blot® Turbo™ Midi Nitrocellulose Transfer Packs (2.5 A, 25 V, 7 min). After a 1 h, room-temperature saturation step in Tris buffered saline, 0.05% Tween 20, 1% milk (TBS-T 1% milk), membranes are incubated 1 h at room temperature with goat anti-hIgG-HRP, Fcγ Fragment specific (1/50000).

TABLE 9

$EC_{50}$ of Ab-bound hIL-15 vs free hIL-15 (recombinant or released after linker cleavage).

| | IL-15 | | NHS76 IL-15 | | H16/L16 IL-15 | | c9G4 IL-15 | |
|---|---|---|---|---|---|---|---|---|
| | −MMP-9 | +MMP-9 | −MMP-9 | +MMP-9 | −MMP-9 | +MMP-9 | −MMP-9 | +MMP-9 |
| $EC_{50}$ (nM) | 0.72 ± 0.57 | 0.71 ± 0.42 | ND† | 8.84 ± 1.08 | ND† | 2.84 ± 1.06 | ND† | 2.07 ± 1.79 |

†$EC_{50}$ values could not be determined due to impaired IL-15 ability to trigger receptor dimerisation. function.

Example 6: In Vivo Stability of ICC

6.1. Materials and Methods

6.1.1. Engraftment of Mice and Injection of ICC

Six-week-old immunocompetent BALB/c mice were used for all in vivo assessments. They were housed in sterilized filter-topped cages, maintained in sterile conditions and manipulated according to French and European guidelines.

RENCA (ATCC: CRL-2947), a murine renal carcinoma cell line expressing PDL1 was selected for in vivo evaluations. Mice were injected subcutaneously at D0 with 0.5×$10^6$ cells. When tumours reached 100 mm³ (11-12 days post tumour cell injection), animals were divided into 9 groups of 6 mice with comparable tumour size and administered intraperitoneally with PDL1-PVGLIG-NanoLuc® or the control isotype c9G4-PVGLIG-NanoLuc®, 200 μg/mouse Q1d1.

6.1.2. Serum Samples

Animals were sacrificed at 0, 3, 6, 24 and 48 hours post administration and blood samples were collected in Na-heparinised tubes by cardiac puncture. Blood samples were centrifuged for 15 min at 1500 g, 4° C. and plasma was After three washes, membranes labelling is analysed on ChemiDoc™ Touch Gel Imaging System.

6.1.5. Softwares

Densitometric analysis of western blot are carried out with Image Lab (Bio-Rad).

Statistical analyses are carried out with GraphPad Prism6.

6.2. Results

6.2.1 In Vivo Stability of ICC in Mice Sera.

The stability of the ICC was evaluated in mice sera as a function of time. FIG. 11 shows the results obtained by western blot at 3 h, 6 h and 24 h post ICC injection. The amount of circulating ICC dramatically decreases as a function of time for each ICC construct tested. Without being bound by theory, this result is most easily explained by the sequestration of the ICC in the tumour and/or by the natural in vivo Ab degradation.

The western blots were submitted to densitometric analysis. The graphic representations (FIG. 12) shows the percentage of uncleaved ICC calculated as follow: [Intensity of the uncleaved ICC/(cleaved+uncleaved)ICC]×100. Both model ICC behaved similarly in blood circulation, i.e. they looked stable over a 6 hours period, before losing progressively their NanoLuc® counterpart.

Overall, there was no significant difference between circulating c9G4 ICC and PDL1 ICC.

6.2.2. In Vivo Stability of ICC in Mice Tumour Samples.

The stability of the ICC was evaluated in mice tumour samples as a function of time. FIG. 14 shows the results obtained by western blot at 3 h, 6 h and 24 h post ICC injection.

The Western Blots were submitted to densitometric analysis, the graphic representations (FIG. 15) show the percentage of uncleaved ICC calculated as previously described.

Both model ICC behaved similarly, i.e., the NanoLuc® counterpart was cleaved in RENCA tumours over a 48-hour period. PDL1 ICC cleavage was detected very quickly (less than 60% of uncleaved form in the tumour as early as 3 hours post-injection). At 24 hour-post injection, more than 80% of the total ICC present in the tumour was cleaved.

The cleavage of the c9G4 ICC was slower, with about 20% of the ICC cleaved in the tumour 6 hours post-injection. However, at 24 hours post injection, more than 80% of the total ICC present in the tumour is cleaved. Statistical analysis was performed on tumour-sequestered ICC. The amount of total tumour sequestered ICC was determined by adding of the signals obtained for the uncleaved ICC and the cleaved ICC at each time point.

FIG. 16 shows a quantitative analysis of total ICC (cleaved and uncleaved) present in the tumours as a function of time.

Overall the PDL1-ICC was more sequestered in the RENCA tumours than the control c9G4 ICC.

These results demonstrate that a tumour-specific ICC is able to accumulate quickly in the tumour environment. After accumulation, the ICC is cleaved by the tumour-specific protease releasing specifically the cytokine in the tumour environment.

6.2.3. In Vivo Stability of ICC in Mice Sera Compared to Tumour Samples.

The behaviour of the two ICC was compared in plasma versus tumour samples in RENCA engrafted mice as a function of time.

FIG. 17 shows that regardless of the nature of the antibody moiety, ICC are significantly more cleaved in the RENCA tumours than in the mouse plasma.

Example 7: In Vitro T Cell Activation with ICC 7.1. Materials and Methods 7.1.1 Materials and Methods.

Recombinant human IL-15 was purchased from PeproTech.

The following ICC constructions were tested:
NHS76-PVGLIG-IL-15;
H16/L16-PVGLIG-IL-15; and
c9G4-PVGLIG-IL-15

The following controls were added: hIL-15, MMP9, hIL-15+MMP9 and individual antibodies.

7.1.2. Methods

The activity of three IL-15-based immunocytokines, i.e. NHS76-IL-15, H16/L16-IL-15, and c9G4-IL-15, was assessed on their ability to activate murine and human CD3$^+$ T cells. The effect of hIL-15+/−MMP9, MMP9 and individual antibodies was also evaluated using the same procedure.

Murine CD3$^+$ T cells were isolated by negative selection from the spleen of balb/c mice (Charles River) using the murine pan T cells isolation kit II (Miltenyi, 130-095-130) according to the manufacturer's instructions. Two spleens per experiment were used for the T cells isolation.

Human peripheral blood mononuclear cells (PBMC) were isolated from fresh blood from healthy donors' cytapheresis rings by density gradient centrifugation. CD3 T cells were then purified by negative selection from PBMC using the human pan T cells isolation kit II (Miltenyi, 130-096-535).

Murine and human CD3$^+$ T cells were seeded at 200 000 cells/well in culture medium, RPM11640+10% FCS+2 mM L-glutamine+10 mM Hepes+1% Penicillin/streptomycin+ 0.1 mM beta-2-mercaptoethanol or RPMI 1640+10% FCS+ 1% L-glutamine+1% Sodium Pyruvate+1% Penicillin/streptomycin, respectively.

They were then treated with human IL-15 as a positive control at 100 and 200 ng/ml or with the different ICC constructions at 6 µg/ml with an equivalent of 200 ng/ml for IL-15 in the presence or not of MMP9. Cells were incubated at 37° C. 5% CO2 and culture medium was refreshed after 3 days.

Activation of CD3$^+$ T cells was monitored after 6 days of treatment through the expression of CD25 and CD69 surface markers. The expression of these markers was assessed by flow cytometry (Novocyte, ACEA). Cell culture supernatants were transferred into 96-wells plates for interferon-γ secretion analysis by flow cytometry (BD, CBA IFN Flex Set).

For each murine and human T cell activation experiment, the analysis was performed in triplicate; three human healthy donors were tested.

Data analysis was performed with the Prism 7.01 software (GraphPad).

7.2. Results

Figure 23A:
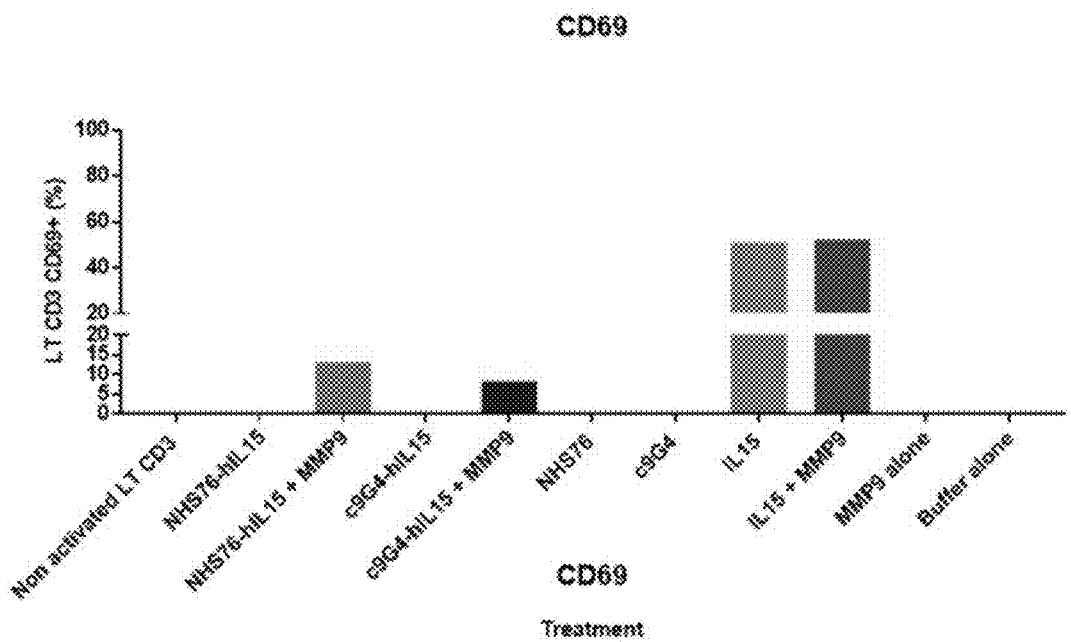
Figure 23B:
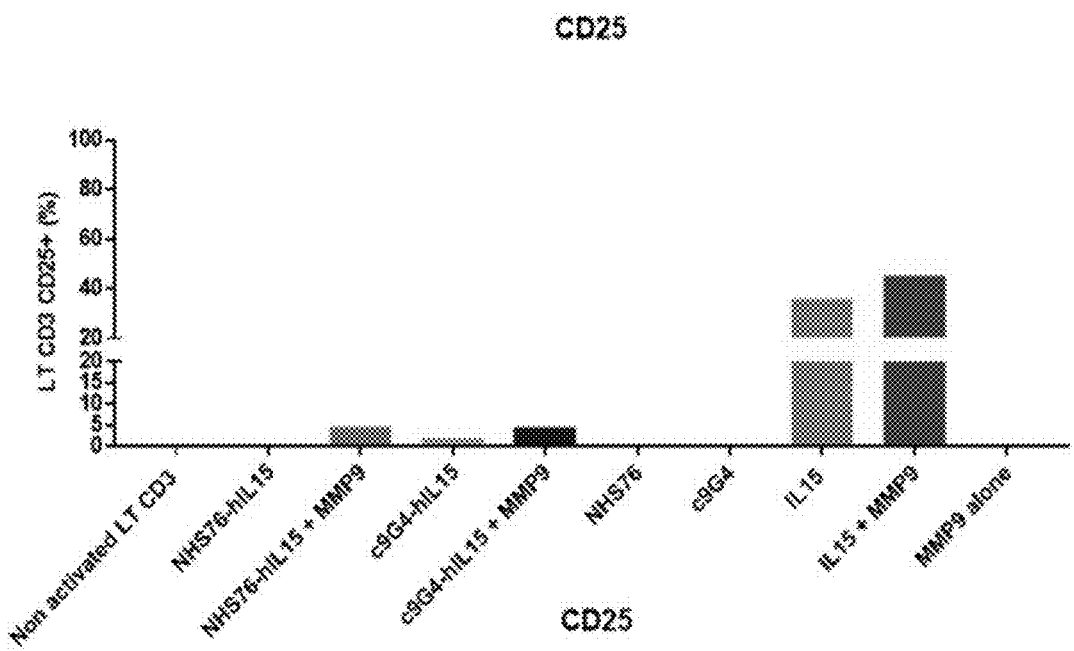
Figure 23C:
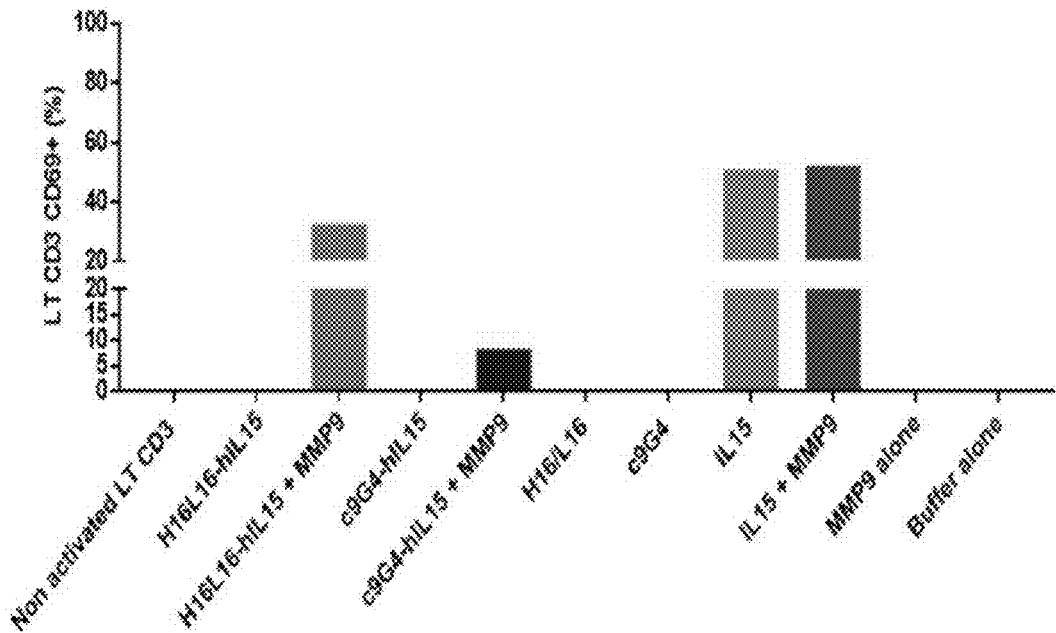
Figure 23D:
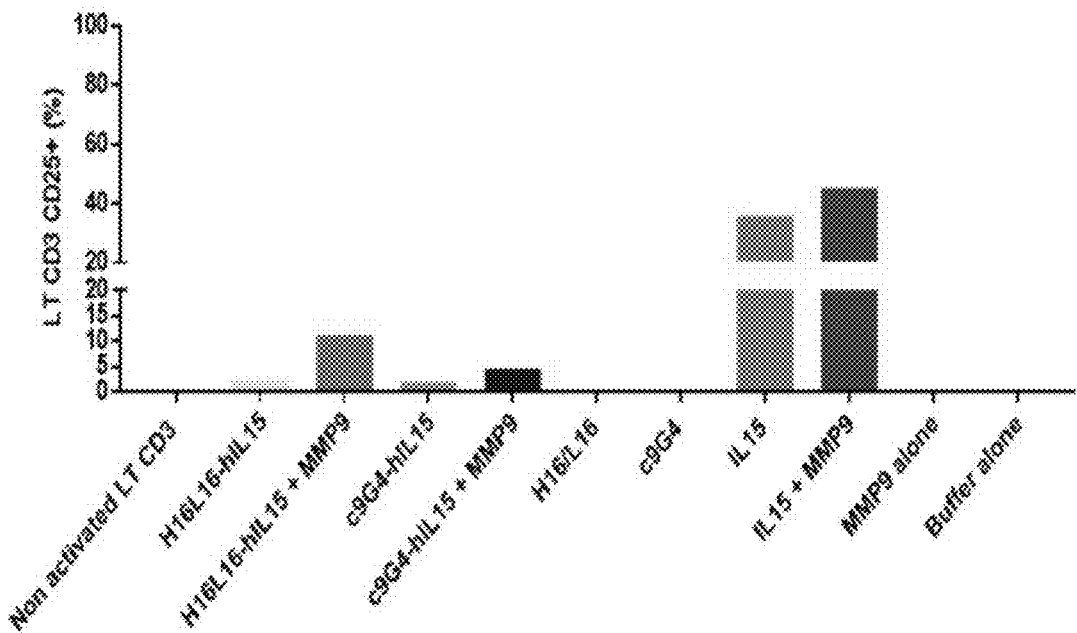
Figure 24A:
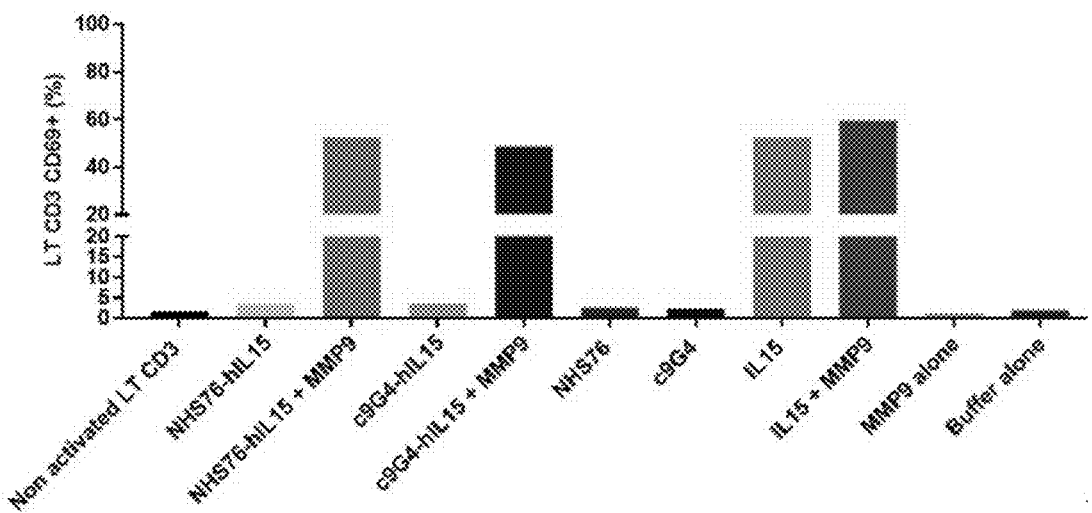
Figure 24B:
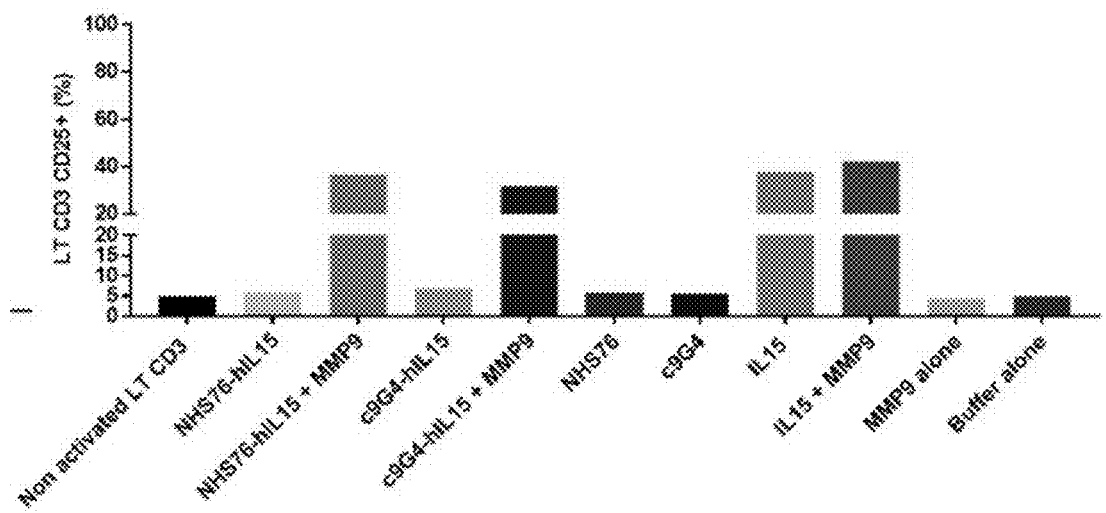
Figure 24C:
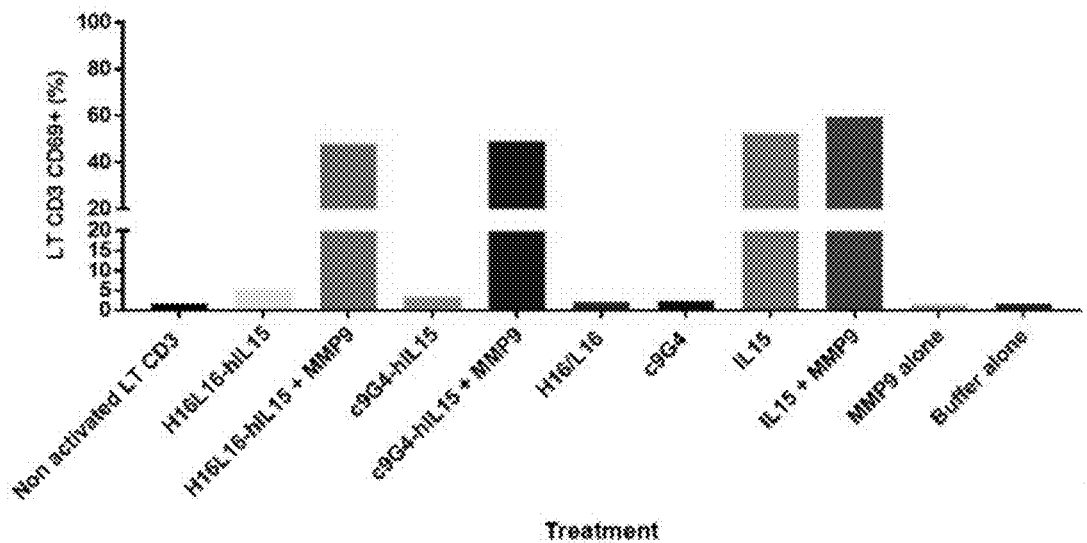
Figure 24D:
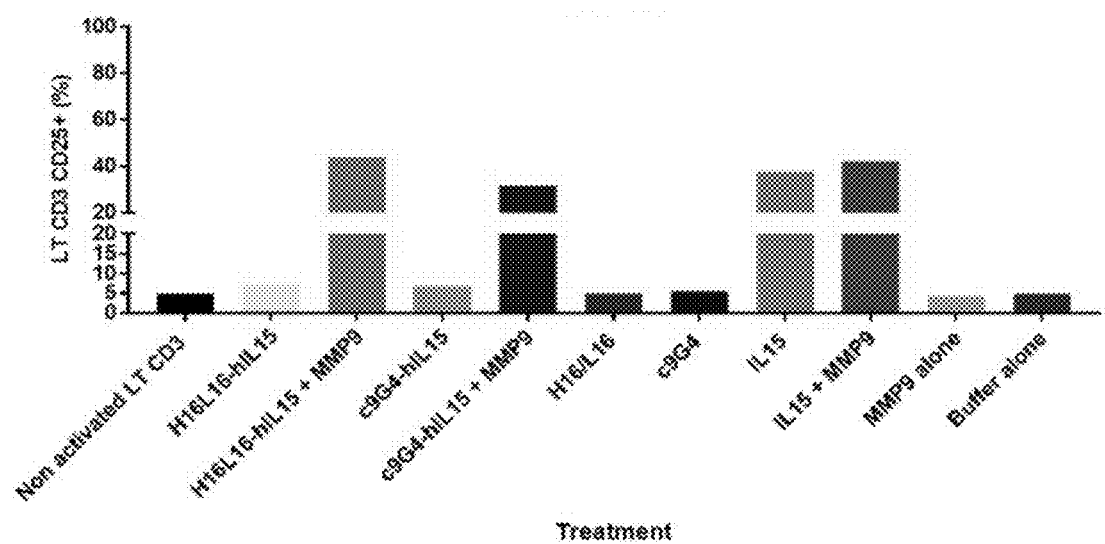
Figure 25A:
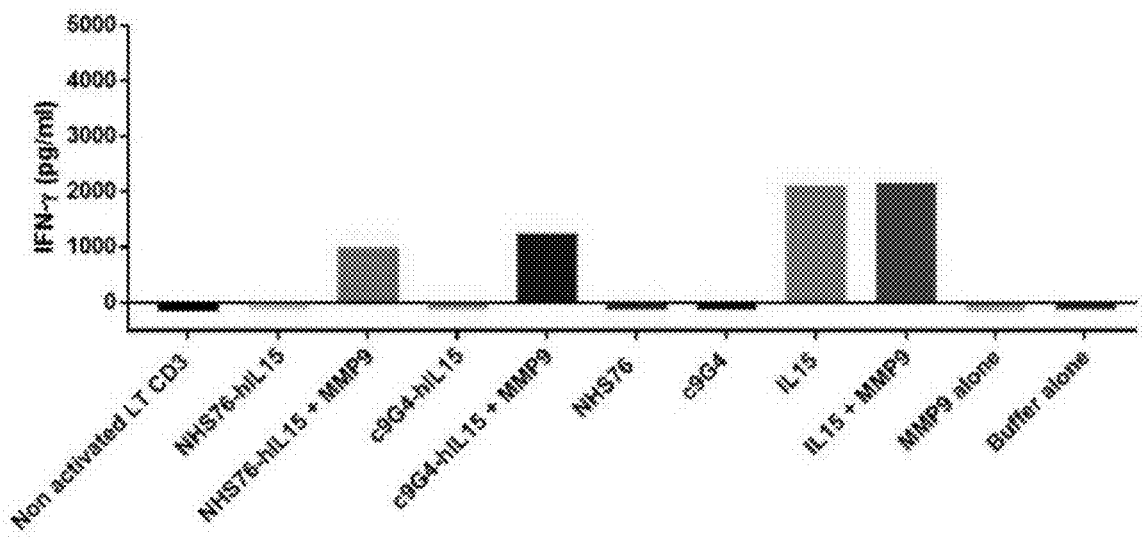
Figure 25B:
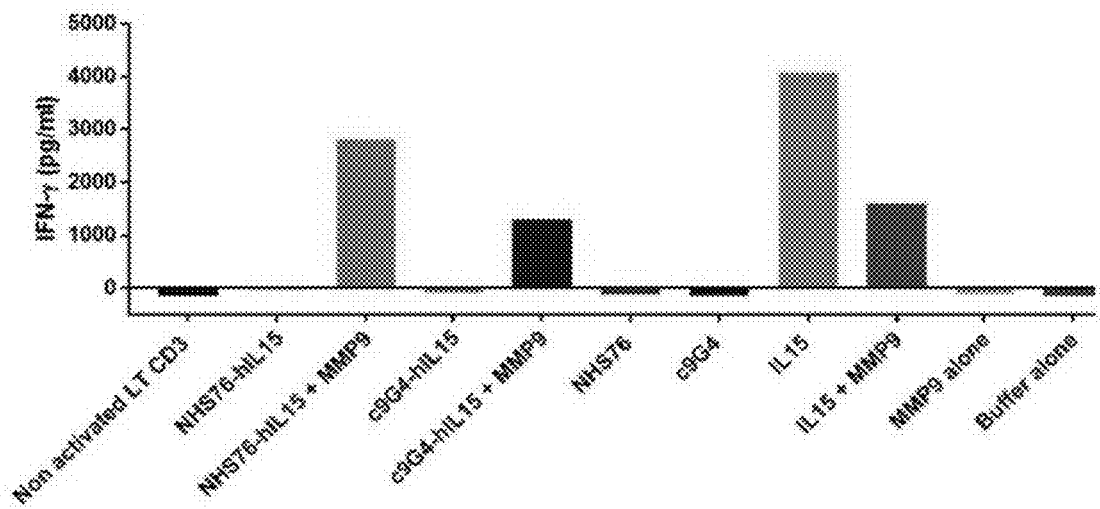
Figure 25C:
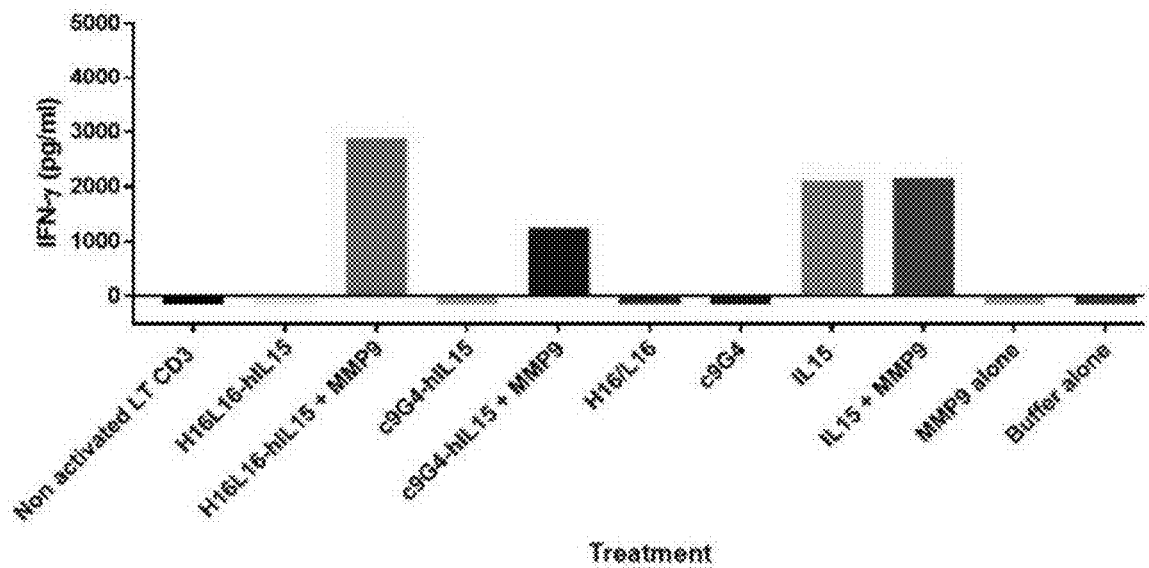
Figure 25D:
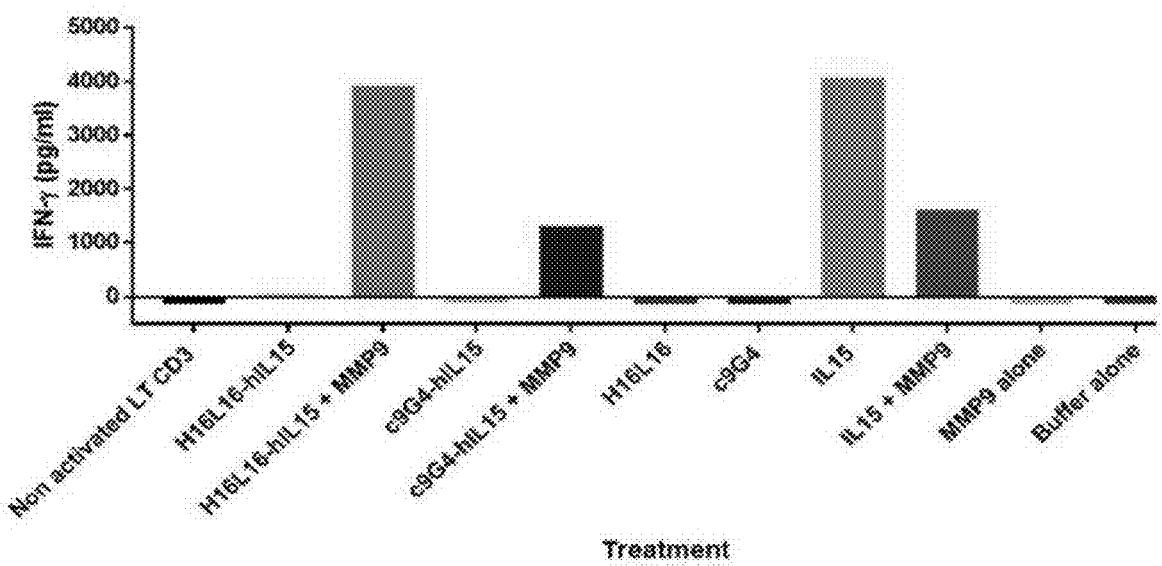

The ability of ICC to activate murine T cells was compared to controls. T cell activation was measured by T cell expression of CD69 or CD25. FIGS. 23A and B, show that NHS76-PVGLIG-IL-15 and c9G4-PVLGIG-IL-15 induce the expression of CD69 and CD25 in presence of MMP-9 but not in the absence of MMP-9. Activation of murine T cells is thus not observed when the ICC are uncleaved. Negative control (antibody alone, MMP-9 alone, buffer alone) or positive control (IL-15 and IL-15+MMP-9 alone) were also tested to confirm the validity of the experiment.

As shown in FIGS. 23 B and C, cleaved H16/L16-PVGLIG-IL-15 (but not the ICC uncleaved form) is also able to activate murine T cell activation in a similar way.

The same experiments were performed with human T cells from healthy donors. T cell activation was measured by T cells expression of CD69 or CD25. NHS76-PVGLIG-IL-15, c9G4-PVLGIG-IL-15 and H16L16-PVGLIG-IL-15 induce expression of CD69 and CD25 in presence of MMP-9 but not in absence of MMP-9 (FIGS. 24 A, B, C and D). Activation of the human T cells was thus not observed when the ICC are uncleaved. Negative control (antibody alone, MMP-9 alone, buffer alone) or positive control (IL-15 and IL-15+MMP-9 alone) were also tested to confirm the validity of the experiment.

This activation of T cells in presence of cleaved (but not of uncleaved ICC) was also measured by the secretion of IFN-γ by human T cells from two different donors.

Example 8: Attenuation of hIL-36γ when Fused to an Antibody

To evaluate and compare the biological activity of hIL-36γ when part of an ICC or after cleavage by MMP9, IL-36γ activity was assayed by measuring CXCL8 production in human epidermoid cancer A431 cell culture. This assay is based on the finding that IL-36γ signaling pathway can trigger CXCL8 secretion.

8.1. Materials and Methods

8.1.1. Materials and Reagents

Recombinant human recombinant pro-MMP-9 was purchased from R&D Systems and activated by 1 mM 4-Aminophenylmercuric acetate (APMA) in buffer containing 50 mM Tris, 150 mM NaCl, 10 mM $CaCl_2$, 0.05% Brij-35 (w/v), pH7.5. APMA was then removed using Zeba™ Spin Desalting Columns (ThermoFisher Scientific) and APMA-free MMP-9 was immediately stored at −80° C. until needed. Recombinant human IL-36γ was purchased from R&D Systems. IL-8 was dosed using the Human IL-8 DuoSet ELISA (R&D Systems).

8.1.2. Methods

To assess the activity of an IL-36γ-based immunocytokine (H16/L16-PVGLIG-IL-36), squamous carcinoma A431 cells were incubated for 24 hours with the ICC or the different control molecules. All the samples were tested in the presence (+MMP-9) or absence (−MMP-9) of recombinant hMMP-9 in an assay buffer containing 50 mM Tris, 150 mM NaCl, 10 mM CaCl2) pH 7.5. The cell culture medium was then collected and hIL-8 dosed by ELISA. The effect of recombinant hIL-36γ and H16/L16 antibody (+/−hMMP-9) was also evaluated using the same procedure. Data analysis was performed with the Prism 7.01 software (GraphPad).

8.2. Results

The results of the hIL-8 production in A431 cultures for the ICC and controls are presented in FIG. 26. Data are expressed in O.D (450 nm) corresponding to hIL-8 expression level as a function of the hIL-36γ concentration.

As seen in FIG. 26, rhIL-36γ and rhIL-36γ+MMP-9 highly induced hIL-8 production by A431 cells and thus validated the experimental format. On the other hand, neither MMP-9 alone nor the antibody H16/L16 (+/−MMP9) had any effect on hIL-8 production as expected.

In the absence of MMP-9, the H16/L16-PVGLIG-hIL-36γ ICC had no significant activity on hIL-8 production. On the other hand, pre-treatment of the same molecules with MMP-9 resulted in activity recovery as observed through IL-8 production in a dose dependent manner.

In summary, the C-terminal linkage of hIL-36γ using PVGLIG to H16/L16 antibody totally attenuates the cytokine activity. A MMP9 cleavage within the PVGLIG peptide restores it at a level comparable those of the free hIL-36γ cytokine at an equivalent dose.

Example 9: Attenuation of hIFNα2α when Fused to an Antibody

In order to evaluate and compare hIFNa2a biological activity when linked to the ICC or after cleavage by MMP9, IFNα2a activity was assayed with a cell-based luciferase reporter bioassay.

9.1. Materials and Methods

9.1.1. Materials and Reagents

Recombinant human recombinant pro-MMP-9 was purchased from R&D Systems and activated by 1 mM 4-Aminophenylmercuric acetate (APMA) in buffer containing 50 mM Tris, 150 mM NaCl, 10 mM CaCl2), 0.05% Brij-35 (w/v), pH7.5. APMA was then removed using Zeba™ Spin Desalting Columns (ThermoFisher Scientific) and APMA-free MMP-9 was immediately stored at −80° C. until needed. Recombinant human IFNα2a was purchased from Pbl Assay Science (rhIFNα2a).

9.1.2. Methods

IFNα2a activity was monitored using the GloResponse™ ISRE-luc2P/HEK293 (Promega). The ISRE-luc2P/HEK293 cell line contains the firefly luciferase gene under the control of ISRE stably integrated into HEK293 cells. Binding of IFNα2a to its receptor leads to the activation of the JAK pathway, thereby promoting ISRE-dependent transcription of the luciferase gene. Luminescence can then be detected upon addition of a substrate and quantified with a luminometer.

The activity of three hIFNα2a-based immunocytokines was assessed: NHS76-PVGLIG-h IFNα2a, H16/L16-PVGLIG-hIFNα2a and c9G4-PVGLIG-hIFNα2a. The effect of recombinant hIFNα2a was also evaluated using the same procedure. All samples were incubated for one hour in presence (+MMP-9) or absence (−MMP-9) of recombinant hMMP-9 in an assay buffer containing 50 mM Tris, 150 mM NaCl, 10 mM CaCl2) pH 7.5.

Cleavage efficiency was controlled by SDS-PAGE analysis and samples were immediately stored at −20° C. until processing. ISRE-luc2P/HEK293 cells were treated with either cleaved or uncleaved ICC or controls overnight. Detection reagent (Bio-Glo™ luciferase Assay reagent) was then added and chemiluminescence intensity was recorded with a microplate reader (Infinite M1000Pro, Tecan). Data analysis was performed with the Prism 7.01 software (GraphPad).

For H16/L16-PVGLIG-hIFNα2a, cells were pre-treated or not with 10 μg of H16/L16 antibody lacking a cytokine fusion in order to saturate IGF1-R binding sites on the ISRE-luc2P/HEK293 cell surface.

9.2. Results

The results of the hIFNα2a activity assay for the three tested ICC are shown in FIG. 27 as a function of the hIFNα2a concentration. The EC50 of each compound or ICC are shown in Table 10.

Both hIFNα2a and hIFNα2a+MMP-9 strongly induce signalling response, as shown by the luciferase expression, thus validating the experiment (FIG. 27 and Table 10).

In the absence of MMP-9, each of the three assessed ICC: c9G4-PVGLIG-hIFNα2a (FIG. 27A), NHS76-PVGLIG-hIFNα2a (FIG. 27B), and H16/L16-PVGLIG-hIFNα2a, with (FIG. 27C) or without (FIG. 27D) preincubation of the cells with 10 μg/ml H16/L16 antibody, showed a highly attenuated activity compared to equimolar concentrations of hIFNα2a activity. On the other hand, pre-treatment of the same molecules with MMP-9 results in activity recovery in a dose dependent manner.

It appears thus clearly from these experiments that hIFNα2a shows an attenuated activity when linked to any of the three antibodies. After cleavage of the ICC by MMP-9, hIFNα2a is liberated in its active form and is again able to fulfil its biological activity.

TABLE 10

| | | | | H16L16-hIFNa2a | |
|---|---|---|---|---|---|
| | hIFNα2a | c9G4-hIFNα2a | NHS76-hIFNα2a | No pre incubation | Pre incubation with H16/L16 |
| −MMP9 | 0.08 ± 0.01 | 4.00 ± 1.40 | 5.33 ± 2.6 | 0.03 ± 0.009 | 0.95 ± 0.05 |
| +MMP9 | 0.05 ± 0.01 | 0.02 ± 0.005 | 0.03 ± 0.008 | 0.02 ± 0 | 0.02 ± 0 |

Example 10: Attenuation of hIL-15 when Fused to an Antibody

To evaluate and to compare the biological activity of hIL-15, when linked to the ICC or after cleavage by uPA, a biological test of IL-15 activity was used (Promega IL-15 Bioassay)

10.1. Materials and Methods

10.1.1. Materials and Reagents

Recombinant urokinase (=uPA) was purchased from Abcam: ab92767 for the human. Recombinant human IL-15 was purchased from PeproTech (200-15).

IL-15 activity was monitored using the IL-15 Bioassay from Promega (Cat. #JA2015). This is a bioluminescent cell-based assay designed to measure IL-15 stimulation or inhibition using the STAT-5 response element as a readout. When IL-15 binds to its receptor, receptor-mediated pathway signalling induces luminescence that can be detected upon addition of a substrate and quantified with a luminometer.

10.1.2. Cleavage

Constructions to evaluate are incubated in PBS with uPA during 24 h at 37° C.

Cleavage efficiency was controlled by SDS-PAGE analysis and samples were immediately stored at −20° C. until processing.

10.1.2. Methods

IL-15 cells were treated for 6 h with either cleaved or uncleaved ICC or controls. Detection reagent (Bio-Glo™ luciferase Assay reagent) was then added and chemiluminescence intensity was recorded with a microplate reader (Mithras, Berthold). Data analysis was performed with the Prism 7.01 software (GraphPad).

10.2. Results

The results of the hIL-15 activity for the ICC and controls are presented in FIG. 28. Data are expressed in relative luminescence (RLU) corresponding to hIL-15 activity level as a function of the STAT-5 activation.

Both rhIL-15 and rhIL-15+uPA highly activated luminescence, thereby validating the experiment format. In the absence of uPA, the H16L16-SGRSA-hIL-15 ICC had no significant IL-15 activity. Pre-treatment of the same molecule with uPA resulted in a significant recovery of activity as observed through the STAT-5 activation (FIG. 28).

In summary, the C-terminal linkage of hIL-15 using SGRSA to H16/L16 antibody totally attenuates its activity. Cleavage by uPA within the SGRSA peptide significantly restores IL-15 activity.

Example 11: Attenuation of hIFNα when Fused to an Antibody

To evaluate and to compare the biological activity of hIFNα, when linked to the ICC or after cleavage by uPA, a biological test of IFNα activity was used (GloResponse ISRE-luc2P).

11.1. Materials and Methods 11.1.1. Materials and Reagents

Recombinant human urokinase (=uPA) was purchased from Abcam (ab92767). Recombinant human IFNα was purchased from PBL (11101-02). IFNα activity was monitored using the GloResponse ISRE-luc2P (Promega CS190701). This is a bioluminescent HEK293 cell-based assay designed to measure IFNα stimulation or inhibition using interferon-stimulated response element (ISRE) that drives transcription of the luciferase reporter gene luc2P (Photinus pyralis). When IFNα binds to its receptor, receptor-mediated pathway signalling induces luminescence that can be detected upon addition of a substrate and quantified with a luminometer.

11.1.2. Cleavage

Constructions to evaluate are incubated in PBS with uPA during 24 h at 37° C. Cleavage efficiency was controlled by SDS-PAGE analysis and samples were immediately stored at −20° C. until processing.

11.1.2. Methods

ISRE-luc2P/HEK293 cells were pre-treated for 1 h with 10 μg of anti IGF1R antibody in order to saturate IGF1R binding sites on the cell surface.

ISRE-luc2P/HEK293 cells were treated with either cleaved or uncleaved ICC or controls overnight. Detection reagent (Bio-Glo™ luciferase Assay reagent) was then added and chemiluminescence intensity was recorded with a microplate reader (Mithras, Berthold). Data analysis was performed with the Prism 7.01 software (GraphPad).

11.2. Results

The results of the hIFNα activity for the ICC and controls are presented in FIGS. 29A and 29B. Data are expressed in relative luminescence (RLU) corresponding to hIFNα activity level as a function of the ISRE activation.

11.2.1 H16L16-SGRSA-hIFNα

As seen in FIG. 29A, rhIFNα and rhIFNα+uPA highly activated luminescence and thus validated the experiment format.

In the absence of uPA, the IFNα EC50 of H16/L16-SGRSA-hIFNα ICC showed a 2-log reduction with only 75% maximal activity. Pre-treatment of the same molecule with uPA resulted in a similar activity to rhIFNα as determined by ISRE activation.

In summary, the C-terminal linkage of hIFNα using SGRSA to H16/L16 antibody attenuates its activity. Cleavage by uPA within the SGRSA peptide restores it at a level similar to that of the free hIFNα cytokine.

11.2.2 H16/L16-PSSRRRVN-hIFNα

As seen in FIG. 29B, r hIFNα and r hIFNα+uPA highly activated luminescence and thus validated the experiment format.

In the absence of uPA, the IFNα EC50 H16/L16-PSSRRRVN-hIFNα ICC displayed a 2-log reduction with a 75% maximal activity. Pre-treatment of the same molecule with uPA resulted in an activity recovery as observed through the ISRE activation.

In summary, the C-terminal linkage of hIFNα using PSSRRRVN to H16/L16 antibody attenuates its activity. Cleavage by uPA within the PSSRRRVN peptide restores activity to a level comparable to the free hIFNα cytokine.

Example 12: Attenuation of hCXCL10 when Fused to an Antibody

To evaluate and compare the biological activity of hCXCL10 when linked to the ICC or after cleavage by uPA, a biological test of β-arrestin recruitment induced by CXCL10 binding to the CXCR3 receptor was performed (PathHunter eXpress CXCR3 CHOK1β-arrestin GPCR assay).

12.1. Materials and Methods 12.1.1. Materials and Reagents

Recombinant human urokinase (=uPA) was purchased from Abcam (ab92767). Recombinant human CXCL10 was purchased from Peprotech (300-12). CXCL10 activity was monitored using the PathHunter eXpress CXCR3 CHOK1 β-arrestin GPCR assay (DiscoverX 93-0271E2). This is a bioluminescent CHO cell-based assay designed to measure β-arrestin recruitment induced by CXCL10 binding to the CXCR3 receptor.

Activation of the GPCR-PK induces β-arrestin-EA recruitment, forcing complementation of the two β-galactosidase enzyme fragments (EA and PK). The resulting functional enzyme hydrolyzes substrate to generate a chemiluminescent signal that can be detected upon addition of a substrate and quantified with a luminometer.

12.1.2. Cleavage

Constructions to evaluate are incubated in PBS with uPA during 1 h at 37° C. Cleavage efficiency was controlled by SDS-PAGE analysis and samples were immediately stored at −20° C. until processing.

12.1.2. Methods

CHO-K1 CXCR3 cells were treated with either cleaved or uncleaved ICC or controls for 1 h30. Detection reagent was then added and chemiluminescence intensity was recorded 1 h later with a microplate reader (Mithras, Berthold). Data analysis was performed with the Prism 7.01 software (GraphPad).

12.2. Results

The results of the hCXCL10 activity for the ICC and controls are presented in FIGS. 30A, 30B and 30C. Data are expressed relative luminescence (RLU) corresponding to hCXCL10 activity level as function of the CXCR3 β-arrestin recruitment.

12.2.1 9G4-SGRS-CXCL10

Both recombinant hCXCL10 and recombinant hCXCL10+uPA led to a strong activation of the luminescence signal, thereby validating the experiment format. In the absence of uPA, the 9G4-SGRS-CXCL10 ICC had no significant activity. Pre-treatment of the same molecules with uPA resulted in an activity recovery as observed through the CXCR3 β-arrestin recruitment (FIG. 30A).

In summary, the C-terminal linkage of hCXCL10 using the SGRS linker to the 9G4 antibody attenuates its activity. Cleavage by uPA within the SGRS peptide restores CXCL10 activity almost to that of the free hCXCL10 cytokine.

12.2.2 NHS76-SGRS-CXCL10

Both recombinant hCXCL10 and recombinant hCXCL10+uPA led to a strong activation of the luminescence signal, thereby validating the experiment format. In the absence of uPA, the NHS76-SGRS-CXCL10 ICC had no significant activity. Pre-treatment of the same molecule with uPA resulted in a partial recovery of activity as observed through the CXCR3 β-arrestin recruitment (FIG. 30B). Full activity was not observed probably due to a partial proteolysis of the parent NHS76-SGRS-CXCL10.

In summary, the C-term linkage of hCXCL10 using SGRS to the NHS76 antibody attenuates its activity. Cleavage by uPA within the SGRS peptide restores CXCL10 activity.

12.2.3 H16L16-SGRS-CXCL10

Both recombinant hCXCL10 and recombinant hCXCL10+uPA led to a strong activation of the luminescence signal, thereby validating the experiment format. In the absence of uPA, the H16/L16-SGRS-CXCL10 ICC had no significant activity. Pre-treatment of the same molecule with uPA resulted in a partially recovery activity as observed through the CXCR3 β-arrestin recruitment (FIG. 30C). Full activity was not observed probably due to a partial proteolysis of the parent H16/L16-SGRS-CXCL10.

In summary, the C-term linkage of hCXCL10 using SGRS to H16/L16 antibody attenuates its activity. Cleavage by uPA within the SGRS peptide restores CXCL10 activity.

Example 13: Constructions Used for Expressing Protein Complexes

A schematic representation of the constructions used in the present study is shown in FIG. 31. These constructions are listed in FIG. 32.

13.1. Obtention of the Immunocytokines (ICC)

Sequences coding for the complete fusion proteins (antibody-linker-cytokine) were cloned into pCDNA3.4 vectors (Thermo FisherScientific) using the HindIII/BamHI restriction sites, including a signal peptide (METDTLLLWVLLL-WVPGSTG Thermo FisherScientific). Fusion proteins were obtained by transient protein expression in Expi HEK293 cells (Thermo FisherScientific) grown to a density of 2.5× $10^6$ cells/ml in Expi293 Expression Medium (Thermo FisherScientific) and co-transfected with 1.25 µg/ml DNA (HC/LC: 1/1 w/w) using polyethyleneimine (PEI, Polyscience, DNA/PEI ratio: 1/4). 2 mM valproic acid (VPA, Sigma-Aldrich) was then added 3 hours post transfection. Supernatants containing the produced fusion proteins were harvested 6 days post-transfection. The fusion protein yield was measured in each supernatant.

13.1. Purification and Characterisation of ICCs

Proteins were purified by affinity chromatography on Protein A-Sepharose and formulated by overnight dialysis against 25 mM sodium citrate, 150 mM NaCl, 6% Saccharose pH 5.5 or 25 mM His/His-HCl, 150 mM NaCl, pH 6.5.

Purified ICCs were analysed by SDS-PAGE and Size Exclusion chromatography (SEC). The SEC running buffer corresponded to the formulation buffer of the analysed ICC. At the research level SEC acceptance criterium is 80% monomers.

As illustrated in FIG. 33, expression of fusion proteins with a cofactor leads to a higher productivity and a lower level of aggregates (i.e., a higher level of monomers). For example, K03201-076 is a fusion protein consisting of the hH16L16 antibody fused to two copies of the L6 linker (PVGLIG) and IL-15. Expression of this protein does not go above 10 mg/L and the monomer rate is 38%. By contrast, expression of sushi+ with this ICC, either as a fusion protein (K03201-072) or through coexpression (K03201-071), results in significant increases in productivity (ca. 60 mg/L and 80 mg/L, respectively) and monomer levels (63% and 86%, respectively). Similar results were obtained with both sushi (K03201-046) and ILR15a (K03201-070).

Thus, the expression of the fusion protein is significantly enhanced by the cofactor.

Example 14: Attenuation of IL-15 when Fused to an Antibody

To evaluate and compare the biological activity of IL-15, when linked to the ICC or after cleavage by MMP9, a bioluminescent cell-based assay designed to measure IL-15 stimulation was performed.

14.1. Materials and Methods 14.1.1 Materials and Reagents

Recombinant human pro-MMP-9 was purchased from R&D Systems and activated with 1 mM 4-Aminophenylmercuric acetate (APMA) in buffer containing 50 mM Tris, 150 mM NaCl, 10 mM CaCl2), 0.05% Brij-35 (w/v), pH7.5. APMA was then removed using Zeba™ Spin Desalting Columns (ThermoFisher Scientific) and APMA-free MMP-9 was immediately stored at −80° C. until needed. Recombinant human IL-15 was purchased from PeproTech.

IL-15 activity was monitored using the IL-15 Bioassay (Promega). This luciferase reporter bioassay consists of a genetically engineered cell line, which comprises the full cytokine signalling pathway and a reporter gene. This cell emits luminescence upon binding of IL-15 to its receptor. This luminescence can then be detected and quantified with a luminometer. In the absence of IL-15, no signalling occurs downstream of IL-15R and a luminescent signal is not generated.

14.1.2 Methods

The activity of different immunocytokines was assessed. All samples were incubated for 24 hours in presence (+MMP-9) or absence (−MMP-9) of recombinant hMMP-9 in an assay buffer containing 50 mM Tris, 150 mM NaCl, 10 mM CaCl2) pH 7.5 with one molecule of MMP9 for 12 molecules of immunocytokine. Cleavage efficiency was controlled by SDS-PAGE analysis and samples were immediately stored at −20° C. until processing. IL-15 Bioassay cells were treated with either cleaved or uncleaved fusion proteins and controls for 6 hours at 37° C. according to the manufacturers protocol.

Detection reagent was added, and luminescence intensity was recorded with a microplate reader (Infinite M1000Pro, Tecan). Data analysis was performed with Prism 7.01 software (GraphPad).

14.2. Results

The results of the IL-15-induced luminescence emission for the various immunocytokines tested are presented in FIG. 34 as a function of IL-15 concentration.

All the molecules tested comprised IL-15 covalently linked to an antibody (H16L16, m9G4, or NHS76) through one or two copies of the linker L6 (PVGLIG). These molecules were expressed with or without different forms of IL-15-Rα (sushi, sushi+ or the entire sIL-15Rα). These cofactors were either covalently linked to the ICC or co-expressed and co purified with the ICC.

In the absence of MMP-9, the evaluated ICC had no significant activity on IL-15 signalling pathway. None of the evaluated fusion proteins induced light emission. By contrast, pre-treatment of the same molecules with MMP-9 results in recovered cytokine activity through IL-15-induced light emission. The same results were obtained independently of the antibody, the number of linker copies, or of the cofactor. In addition, whether the cofactor is covalently linked or coexpressed with the tested fusion protein does not influence neither IL-15 attenuation in the absence of MMP-9 nor the induction of IL-15 activity in the presence of MMP-9.

It appears thus clearly from these experiments that IL-15 in each of the various configurations tested shows a highly attenuated cytokine activity when fused to an antibody. After cleavage of the fusion proteins by MMP-9, IL-15 is liberated in its active form and is able to fulfil its biological activity.

Example 15: In Vitro Evaluation of ICC Constructs in an NK Cell Assay

Since IL-15 is critical for the development and expansion of NK cells, biological activity of the IL-15 moiety of the ICC, with or without cleavage by MMP9, was measured and evaluated in an assay designed to measure NK cell activation.

15.1. Methods

Murine NK cells were purified from spleen of Balb/c byJ mouse (Charles River), using the NK Cell Isolation Kit Mouse and following the manufacturer's instructions (Miltenyi).

After purification, NK cells were plated at the density of 50 000 cells per well in a 96 multi well plate and incubated with either IL-15 (100 ng/ml) or ICC (dose equivalent to IL-15 100 ng/ml), pre-incubated or not with MMP9. After 72 h incubation, IFNγ was dosed in the supernatant and percentage of NKp46 positive cells as well as CD69 expression were evaluated on NK cells by flow cytometry.

15.2. Results

The results of the NK activation assay for the various immunocytokines tested are displayed in FIG. 35. In particular, the % of CD69+ NK cells and the level of IFNγ produced were determined for each fusion protein, as well as the total number of NKp46 positive cells.

Each of the tested fusion proteins contained IL-15 covalently linked to an antibody (H16L16, m9G4, or NHS76) through one or two copies of the linker L6 (PVGLIG). These molecules were expressed with or without different forms of IL-15-Ra (sushi+ or the entire sIL-15Rα). These cofactors were either covalently linked to the ICC or co-expressed and co purified with the ICC. In addition, negative controls (naked antibodies) or positive controls (IL-15) were also tested to confirm the validity of the experiment.

As expected, neither naked antibodies nor uncleaved ICC were able to activate NK cells in the tested conditions. After cleavage, K03201-002 and K03201-073 were not able to activate NK cells, as no IFNγ was detected in the supernatant and there was no CD69 positive cells. After cleavage all other constructs induced higher activation than the rIL-15 introduced as positive control (FIG. 35). On the other hand, activation of NK cells was not observed when these ICCs are uncleaved.

It appears thus clearly from this experiment that IL-15 shows an attenuated activity when linked to any of the antibodies. After cleavage of the ICC by MMP-9, IL-15 is liberated in its active form and is again able to fulfil its biological activity.

Example 16: Pharmacokinetic Evaluation 16.1. Methods

The clearance of immunocytokine constructs was assessed in mice following single intravenous administration (bolus dosing at tail vein) of 0.53 nmol in female BALB/cByJ mice i.e. about 20-25 nmol/kg. Animals were housed in accordance with regulations set out in Directive 2010/63/EU of the European Parliament and of the Council of 22 Sep. 2010 and French decree No. 2013-118 of 1 Feb. 2013 (Official Journal of the French Republic of 7 Feb. 2013).

Blood samples were collected using K2 EDTA micro capillary glass tubes at the following sampling times:

T 0.5, 1, 3, 6, 24 and 48 hours after dosing (sampling to tail vein) for the first study and T 0.05, 1, 5, 24, 48, 72, 168 hours after dosing (sampling to saphenous vein) for the second study.

Animals were monitored during all of the in life experimental phase.

Plasma were prepared, and 5-fold diluted in PBS, then stored at −80° C. until analysis.

Concentrations (ng/mL) of total antibody (cleaved and uncleaved ICC) and of total ICC (antibody with at least one remaining IL-15) were determined in plasma samples by ligand binding assay using MesoScale Discovery technology. mAb anti-human IgG (CH2 domain) for total antibody assay and pAb anti-human IL-15 for total ICC assay were used as capture; pAb anti-human IgG (Fc specific) Sulfo-TAG Labelled was used for detection in both assays.

The area under curve, i.e. AUC(0-last) (h*nmol/L), was calculated from each plasma concentration-time profile using the linear up-log down trapezoidal rule using Phoenix WinNonlin Certara (version 8.1.0).

To facilitate the comparison, AUC were corrected for the dose expressed in nmol/kg.

Sample compounds in study 1 evaluated IgG1 and IgG4 isotypes and covalently linked sushi or sushi+ domains. Sample compounds in study 2 evaluated IgG1 and IgG4 isotypes and co-expressed (non-covalent) sushi+ or complete IL-15Rα extracellular domain. Evaluated samples were generated with either a single or double copy of the protease sensitive linker between antibody Fc and IL-15.

16.2. Results

In the first study, all constructs were compared regarding their AUC(0-last)/dose for total antibody which translates to the exposure of animals. Of the 6 ICCs evaluated, the best exposures were obtained for ICC-IL-15-sushi+ covalent constructs (see FIG. 36). Among all constructs, the IgG4 isotype sushi+ construct (K03201-075) displayed the profile closest to that of the parental antibody with an IgG1 isotype, with a plasma exposure equivalent to 74.5% of the parent antibody.

In the second study, the total antibody plasma exposure of animals for sushi+ and sIL-15Rα constructs were better than for the basic construct (K03201-002) for all construct variants irrespective of linker repeats, isotype or co-expressed factor (see FIG. 37A). The sushi+ simple linker constructs were better tolerated than those with double linkers.

In addition, the exposure of animals to total ICC for sushi+ and IL-15Rα constructs was determined. The plasma exposure of animals to total ICC was also higher for sushi+ than for sIL-15Rα constructs (see FIG. 37B).

Example 17: In Vivo Effects of the ICCs on a Renal Carcinoma Cell Line 17.1. In Vivo Evaluation of K03201-079 Effect on NK Cells in the RENCA Model 17.1.2 Materials and Methods Ten to twelve-week-old female Balb/c byJ mice (Charles River) were engrafted with $0.5.10^6$ RENCA cells, subcutaneously using a needle for each mouse. Mice were maintained in individual cages (10 mice/cage) at constant temperature and humidity in accordance with regulations set out in Directive 2010/63/EU of the European Parliament and of the Council of 22 Sep. 2010 and French decree No. 2013-118 of 1 Feb. 2013 (Official Journal of the French Republic of 7 Feb. 2013).

Eleven days after cell engraftment, when tumours reached around 100 mm³, mice were randomised and allocated in treatment groups (8 mice per group). Mice received IV injection of either vehicle or K03201-079 dosed at 10 µg, 20 µg and 50 µg, at D0 and D3 post-randomisation.

Twenty-four hours post last injection, mice were euthanised and tumours were sampled for flow cytometry analysis of the NK cell population.

Briefly, tumours were dissociated using the Tumour Dissociation Kit Mouse (Miltenyi) and the Gentle MACS Octo Dissociator (protocol 37C_m_TDK_2) (Miltenyi). Tumour cell suspensions were filtered on 70 µm Smart Stainers and count with ViCell. Tumour cell suspensions were then centrifuged and cell concentration adjusted to $20.10^6$ cells/mL in cold FACS buffer.

$2.10^6$ of tumour cell suspension were plated on 96 well plate with V bottom, Fc Receptor on cells were blocked using FcR Blocking Reagent Mouse, and then 10 µg/mL of alone or mixed fluorescent antibodies were added in each well, and samples were analysed by flow cytometry.

17.1.2 Results

K03201-079 comprises the IL-15 cytokine bound to the H16L16 antibody (ganitumab) through the L6 linker and co-expressed with sushi+. A dose-dependent increase of the number of NK cells within the tumours is induced following administration of K03201-079 (see FIG. 38A). IL-15 is thus targeted correctly to the tumour where it induces the expected immune response.

17.1. In Vivo Comparison of K03201-079 and rIL-15 Effect on NK Cells in the RENCA Model

17.1.2 Materials and Methods

Ten to twelve-week-old female Balb/c byJ mice (Charles River) were engrafted with $0.5.10^6$ RENCA cells, subcutaneously using a needle for each mouse. Mice were maintained in individual cages (10 mice/cage) at constant temperature and humidity following European Guidelines recommendations.

Eleven days after cell engraftment, when tumours reached around 100 mm³, mice were randomised and allocated in groups of treatment (8 mice per group). Mice received IV injection of either vehicle, K03201-079 dosed at 20 µg or subcutaneous injection of rIL-15IL-15 dosed at 6 µg (equivalent dose to 20 µg of K033201-079) at D0 post-randomisation.

Ninety-six hours post last injection, mice were euthanised and tumours were sampled for flow cytometry analysis of the NK cell population.

Briefly, tumours were dissociated using the Tumour Dissociation Kit Mouse (Miltenyi) and the Gentle MACS Octo Dissociator (protocol 37C_m_TDK_2) (Miltenyi). Tumour cell suspensions were filtered on 70 µm Smart Strainers and enumerated by ViCell. Tumour cell suspensions were then centrifuged and cell concentration adjusted to $20.10^6$ cells/mL in cold FACS buffer.

Then $2.10^6$ of tumour cell suspension was plated in 96 well plates with V bottoms. Fc Receptor on cells were blocked using FcR Blocking Reagent Mouse, and then 10 µg/mL of simple or mixed fluorescent antibodies were added in each well, and the samples were analysed by flow cytometry.

17.2.2 Results

When rIL-15 was injected subcutaneously at 6 µg, no increase of the NK cell number was observed within the tumours. However, the equivalent dose of IL-15 administrated via the K03201-079 is able to induce a 4.8 fold increase of the NK cell number in the tumours (see FIG. 38B).

---

SEQUENCE LISTING (242 sequences)

SEQ ID NO: 1 - DNA, 354 bp, Artificial
  Atezolizumab Heavy Chain Variable Region
gaggtccagcttgtcgagtcaggtggaggtcttgtacagccaggaggaagtttgcgtttgagctgcgctgcttctgggttcacttttagcgactcctggatccactgggtcagacaggcacctggaaaggggctggaatgggttgcatggatttccccctacggcggctctacttattacgctgacagtgttaaaggcaggtttaccataagcgccgacacctccaaaaacaccgcctacctgcagatgaatagtctgcgagccgaagatactgccgtgtactattgcgcccggcgccattggcccggcggctttgattattgggggcaagggacactggtgacagtgtctgct

SEQ ID NO: 2 - protein, 118 aa, Artificial
  Atezolizumab Heavy Chain Variable Region
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 3 - DNA, 320 bp, Artificial
  Atezolizumab Light Chain Variable Region
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaa

SEQ ID NO: 4 - protein, 107 aa, Artificial [sequence omitted]

SEQ ID NO: 5 - DNA, 357 bp, Artificial
  Ganitumab Heavy Chain Variable Region
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagc

SEQ ID NO: 6 - protein, 119 aa, Artificial [sequence omitted]

SEQ ID NO: 7 - DNA, 336 bp, Artificial
  Ganitumab Light Chain Variable Region
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagggtggaggctgaggatgttggggtttattactgcatgcaaggtacacactggcctctgacgttcggccaagggaccaaggtggagatcaaa

SEQ ID NO: 8 - protein, 112 aa, Artificial [sequence omitted]

SEQ ID NO: 9 - DNA, 351 bp, Artificial
  NHS76 Heavy Chain Variable Region
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttca

SEQ ID NO: 10 - protein, 117 aa, Artificial
  NHS76 Heavy Chain Variable Region
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSS

SEQ ID NO: 11 - DNA, 324 bp, Artificial
  NHS76 Heavy Chain Variable Region
tcctctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggattccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtccta

SEQ ID NO: 12 - protein, 108 aa, Artificial
  NHS76 Heavy Chain Variable Region
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 13 - DNA, 339 bp, Artificial
  9G4 Heavy Chain Variable Region
gaagtgatgttggtggagtctgggggaggcttagtgaagcctggagggtccctgaaactctcctgtacagcctctggattcactttcagtacctatgacatgtcttgggttcgccagactccggagaagaggctggagtgggtctcaaccattagtagtagtcgtacttacacctactattcagccagtgtgaaggggcgattcaccatctccagagacaatgccaggaacatcctgtacctgcaaatgagcagtctgaggtctgaggacacggccatgtattactgtgcaagacaattttctcactggggccaagggactctggtcactgtctctgca

SEQ ID NO: 14 - protein, 113 aa, Artificial
  9G4 Heavy Chain Variable Region
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSA

SEQ ID NO: 15 - DNA, 336 bp, Artificial
  9G4 Heavy Chain Variable Region
gatgttgtgatgacccagactccactcactttgtcggttaccattggacaaccagcctccatctcttgcaagtcaagtcagagcctcttagatagtgatggaaagacatatttgaattggttgttacagaggccaggccagtctccaacgcgcctaatctatctggtgtctaaactggactctggagtccctgacaggttcactggcagtggatcagggacagatttcacactgaagatcagcagagtggaggctgaggatttgggagtttattattgctggcaaggtacacattttcctcacacgttcggaggggggaccaagctggaaataaaa

SEQ ID NO: 16 - protein, 112 aa, Artificial
  9G4 Heavy Chain Variable Region
DVVMTQTPLTLSVTIGQPASISCKSSQSLLDSDGKTYLNWLLQRPGQSPTRLIYLVSKLDSGVPDRFTGSGSGTDFTLKISRVEAEDLGVYYCWQGTHFPHTFGGGTKLEIK

SEQ ID NO: 17 - DNA, 987 bp, Human
gcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggc

SEQ ID NO: 18 - protein, 329 aa, Human
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 19 - DNA, 978 bp, Human
gcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagtctagatggcaggaaggcaacgtcttcagctgcagcgtgatgcacgaggccctgcacaaccactacacccagaagtccctgagcctgagcctggga

SEQ ID NO: 20 - protein, 326 aa, Human
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 21 - DNA, 321 bp, Human
cgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 22 - protein, 107 aa, Human [sequence omitted]

SEQ ID NO: 23 - DNA, 318 bp, Human
ggtcaacccaaggccgctcccagcgtgaccctgttccccccctcgagcgaggagctgcaggccaacaaggccaccctggtgtgtctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgaccccagagcagtggaagagccacaggagctacagctgccaggtcacccacgagggcagcaccgtggaaaagaccgtggccccaaccgagtgctcc

SEQ ID NO: 24 - protein, 106 aa, Human
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 25 - DNA, 342 bp, Human
aactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 26 - protein, 114 aa, Human
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 27 - DNA, 399 bp, Human
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 28 - protein, 133 aa, Human [sequence omitted]

SEQ ID NO: 29 - DNA, 207 bp, Human
gcaccaatgggctcagaccctcccaccgcctgctgcttttcttacaccgcgaggaaacttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaac

SEQ ID NO: 30 - protein, 69 aa, Human
APMGSDPPTACCFSYTARKLPRNFVVDYYETSSLCSQPAVVFQTKRSKQVCADPSESWVQEYVYDLELN

SEQ ID NO: 31 - DNA, 495 bp, Human
tgtgatctgcctcaaacccacagcctgggtagcaggaggaccttgatgctcctggcacagatgaggaaaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 32 - protein, 165 aa, Human
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 33 - DNA, 513 bp, Oplophorus gracilirostris
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 34 - protein, 173 aa, Oplophorus gracilirostris
LEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 35 - DNA, 18 bp, Artificial
  linker
ccgctgggcctggcgggc

SEQ ID NO: 36 - protein, 6 aa, Artificial
  linker
PLGLAG

SEQ ID NO: 37 - DNA, 24 bp, Artificial
  linker
ggcccgctgggcattgcgggccag

SEQ ID NO: 38 - protein, 8 aa, Artificial
  linker
GPLGIAGQ

SEQ ID NO: 39 - DNA, 24 bp, Artificial
  linker
ggcccgctgggcctgtgggcgcag

SEQ ID NO: 40 - protein, 8 aa, Artificial
  linker
GPLGLWAQ

SEQ ID NO: 41 - DNA, 24 bp, Artificial
  linker
ggcccgctgggcatgctgagccag

SEQ ID NO: 42 - protein, 8 aa, Artificial
  linker
GPLGMLSQ

SEQ ID NO: 43 - DNA, 18 bp, Artificial
  linker
ccggtgggcctgattggc

SEQ ID NO: 44 - protein, 6 aa, Artificial
  linker
PVGLIG

SEQ ID NO: 45 - DNA, 18 bp, Artificial
  linker
ggcattgtgggaccgctg

SEQ ID NO: 46 - protein, 6 aa, Artificial
  linker
GIVGPL

SEQ ID NO: 47 - DNA, 6 bp, Artificial
  linker
ctcgag

SEQ ID NO: 48 - protein, 2 aa, Artificial
  linker
LE

SEQ ID NO: 49 - DNA, 1704 bp, Artificial
  Heavy Chain of Ganitumab-PVGLIG-IL15
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 50 - protein, 568 aa, Artificial
  Heavy Chain of Ganitumab-PVGLIG-IL15
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 51 - DNA, 1698 bp, Artificial
  Heavy Chain of NHS76-PVGLIG-IL15
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 52 - protein, 566 aa, Artificial
  Heavy Chain of NHS76-PVGLIG-IL15
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 53 - DNA, 657 bp, Artificial
  Ganitumab Light Chain
gatgttgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagggtggaggctgaggatgttggggtttattactgcatgcaaggtacacactggcctctgacgttcggccaagggaccaaggtggagatcaaacgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 54 - protein, 219 aa, Artificial
  Ganitumab Light Chain
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - DNA, 645 bp, Artificial
  NHS76 Light Chain
tcctctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggattccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggtcaacccaaggccgctcccagcgtgaccctgttccccccctcgagcgaggagctgcaggccaacaaggccaccctggtgtgtctgatcagcgacttctacccaggcgccgtgaccgtggcctggaaggccgacagcagccccgtgaaggccggcgtggagaccaccacccccagcaagcagagcaacaacaagtacgccgccagcagctacctgagcctgaccccagagcagtggaagagccacaggagctacagctgccaggtcacccacgagggcagcaccgtggaaaagaccgtggccccaaccgagtgctcctga

SEQ ID NO: 56 - protein, 214 aa, Artificial
  NHS76 Light Chain
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 57 - DNA, 1875 bp, Artificial
  heavy chain of PD-L1-GPLGMLSQ-NanoLuc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcatgctgagccagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 58 - protein, 625 aa, Artificial
  heavy chain of PD-L1-GPLGMLSQ-NanoLuc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGMLSQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 59 - DNA, 1185 bp, Artificial
  light chain of PD-L1-GPLGMLSQ-NanoLuc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcatgctgagccagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 60 - protein, 395 aa, Artificial
  light chain of PD-L1-GPLGMLSQ-NanoLuc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGMLSQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 61 - DNA, 1869 bp, Artificial
  heavy chain of PD-L1-GPLGMLSQ-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcatgctgagccaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 62 - protein, 623 aa, Artificial
  heavy chain of PD-L1-GPLGMLSQ-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGMLSQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 63 - DNA, 1179 bp, Artificial
  light chain of PD-L1-GPLGMLSQ-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcatgctgagccaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 64 - protein, 393 aa, Artificial
  light chain of PD-L1-GPLGMLSQ-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGMLSQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - DNA, 1755 bp, Artificial
  heavy chain of PD-L1-GPLGMLSQ-IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcatgctgagccaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 66 - protein, 585 aa, Artificial
  heavy chain of PD-L1-GPLGMLSQ-IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGMLSQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 67 - DNA, 1065 bp, Artificial
  light chain of PD-L1-GPLGMLSQ-IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcatgctgagccaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 68 - protein, 355 aa, Artificial
  light chain of PD-L1-GPLGMLSQ-IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGMLSQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 69 - DNA, 1755 bp, Artificial
  heavy chain of PD-L1-GPLGMLSQ-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcatgctgagccaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 70 - protein, 585 aa, Artificial
  heavy chain of PD-L1-GPLGMLSQ-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGMLSQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 71 - DNA, 1065 bp, Artificial
  light chain of PD-L1-GPLGMLSQ-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcatgctgagccaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 72 - protein, 355 aa, Artificial
  light chain of PD-L1-GPLGMLSQ-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGMLSQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - DNA, 1875 bp, Artificial
  heavy chain of PD-L1-GPLGIAGQ -Nanoluc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcattgcgggccagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 74 - protein, 625 aa, Artificial
  heavy chain of PD-L1-GPLGIAGQ -Nanoluc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGIAGQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 75 - DNA, 1185 bp, Artificial
  light chain of PD-L1-GPLGIAGQ -Nanoluc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcattgcgggccagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 76 - protein, 395 aa, Artificial
  light chain of PD-L1-GPLGIAGQ -Nanoluc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGIAGQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 77 - DNA, 1869 bp, Artificial
  heavy chain of PD-L1-GPLGIAGQ -Nanoluc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcattgcgggccaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 78 - protein, 623 aa, Artificial
  heavy chain of PD-L1-GPLGIAGQ -Nanoluc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGIAGQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 79 - DNA, 1179 bp, Artificial
  light chain of PD-L1-GPLGIAGQ -Nanoluc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcattgcgggccaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 80 - protein, 393 aa, Artificial
  light chain of PD-L1-GPLGIAGQ -Nanoluc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGIAGQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - DNA, 1755 bp, Artificial
  heavy chain of PD-L1-GPLGIAGQ -IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcattgcgggccaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 82 - protein, 585 aa, Artificial
  heavy chain of PD-L1-GPLGIAGQ -IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGIAGQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 83 - DNA, 1065 bp, Artificial
  light chain of PD-L1-GPLGIAGQ -IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcattgcgggccaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 84 - protein, 355 aa, Artificial
  light chain of PD-L1-GPLGIAGQ -IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGIAGQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 85 - DNA, 1755 bp, Artificial
  heavy chain of PD-L1-GPLGIAGQ -IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcattgcgggccaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 86 - protein, 585 aa, Artificial
  heavy chain of PD-L1-GPLGIAGQ -IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGIAGQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 87 - DNA, 1065 bp, Artificial
  light chain of PD-L1-GPLGIAGQ -IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcattgcgggccaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 88 - protein, 355 aa, Artificial
  light chain of PD-L1-GPLGIAGQ -IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGIAGQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - DNA, 1875 bp, Artificial
  heavy chain of PD-L1-GPLGLWAQ -NanoLuc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcctgtgggcgcagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 90 - protein, 625 aa, Artificial
  heavy chain of PD-L1-GPLGLWAQ -NanoLuc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGLWAQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 91 - DNA, 1185 bp, Artificial
  light chain of PD-L1-GPLGLWAQ -NanoLuc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcctgtgggcgcagctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 92 - protein, 395 aa, Artificial
  light chain of PD-L1-GPLGLWAQ -NanoLuc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGLWAQLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 93 - DNA, 1869 bp, Artificial
  heavy chain of PD-L1-GPLGLWAQ -NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcctgtgggcgcaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 94 - protein, 623 aa, Artificial
  heavy chain of PD-L1-GPLGLWAQ -NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGLWAQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 95 - DNA, 1179 bp, Artificial
  light chain of PD-L1-GPLGLWAQ -NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcccgctgggcctgtgggcgcaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 96 - protein, 393 aa, Artificial
  light chain of PD-L1-GPLGLWAQ -NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGPLGLWAQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - DNA, 1755 bp, Artificial
  heavy chain of PD-L1-GPLGLWAQ -IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcccgctgggcctgtgggcgcaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 98 - protein, 585 aa, Artificial
  heavy chain of PD-L1-GPLGLWAQ -IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGPLGLWAQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 99 - DNA, 1065 bp, Artificial
  light chain of PD-L1-GPLGLWAQ -IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcccgctgggcctgtgggcgcaggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 100 - protein, 355 aa, Artificial
  light chain of PD-L1-GPLGLWAQ -IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGPLGLWAQAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 101 - DNA, 1755 bp, Artificial
  heavy chain of PD-L1-GPLGLWAQ -IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcctgtgggcgcaggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 102 - protein, 585 aa, Artificial
  heavy chain of PD-L1-GPLGLWAQ -IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGLWAQEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 103 - DNA, 1065 bp, Artificial
  light chain of PD-L1-GPLGLWAQ -IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcccgctgggcctgtgggcgcaggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 104 - protein, 355 aa, Artificial
  light chain of PD-L1-GPLGLWAQ -IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGPLGLWAQDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - DNA, 1869 bp, Artificial
  heavy chain of PD-L1-PVGLIG -NanoLuc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 106 - protein, 623 aa, Artificial
  heavy chain of PD-L1-PVGLIG -NanoLuc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 107 - DNA, 1179 bp, Artificial
  light chain of PD-L1-PVGLIG -NanoLuc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcccggtgggcctgattggcctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 108 - protein, 393 aa, Artificial
  light chain of PD-L1-PVGLIG -NanoLuc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPVGLIGLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 109 - DNA, 1863 bp, Artificial
  heavy chain of PD-L1-PVGLIG -NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgccggtgggcctgattggcgaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 110 - protein, 621 aa, Artificial
  heavy chain of PD-L1-PVGLIG -NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAPVGLIGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 111 - DNA, 1173 bp, Artificial
  light chain of PD-L1-PVGLIG -NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgccggtgggcctgattggcgacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 112 - protein, 391 aa, Artificial
  light chain of PD-L1-PVGLIG -NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAPVGLIGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - DNA, 1749 bp, Artificial
  heavy chain of PD-L1-PVGLIG-IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcgcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 114 - protein, 583 aa, Artificial
  heavy chain of PD-L1-PVGLIG-IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 115 - DNA, 1059 bp, Artificial
  light chain of PD-L1-PVGLIG-IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcccggtgggcctgattggcgcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 116 - protein, 353 aa, Artificial
  light chain of PD-L1-PVGLIG-IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPVGLIGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 117 - DNA, 1749 bp, Artificial
  heavy chain of PD-L1-PVGLIG-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactccggtgggcctgattggcgaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 118 - protein, 583 aa, Artificial
  heavy chain of PD-L1-PVGLIG-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTPVGLIGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 119 - DNA, 1059 bp, Artificial
  light chain of PD-L1-PVGLIG-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactccggtgggcctgattggcgacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 120 - protein, 353 aa, Artificial
  light chain of PD-L1-PVGLIG-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTPVGLIGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - DNA, 1869 bp, Artificial
  heavy chain of PD-L1-PLGLAG-NanoLuc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccgctgggcctggcgggcctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 122 - protein, 623 aa, Artificial
  heavy chain of PD-L1-PLGLAG-NanoLuc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPLGLAGLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 123 - DNA, 1179 bp, Artificial
  light chain of PD-L1-PLGLAG-NanoLuc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcccgctgggcctggcgggcctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 124 - protein, 393 aa, Artificial
  light chain of PD-L1-PLGLAG-NanoLuc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPLGLAGLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 125 - DNA, 1863 bp, Artificial
  heavy chain of PD-L1-PLGLAG-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgccgctgggcctggcgggcgaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 126 - protein, 621 aa, Artificial
  heavy chain of PD-L1-PLGLAG-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAPLGLAGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 127 - DNA, 1173 bp, Artificial
  light chain of PD-L1-PLGLAG-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgccgctgggcctggcgggcgacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 128 - protein, 391 aa, Artificial
  light chain of PD-L1-PLGLAG-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAPLGLAGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - DNA, 1749 bp, Artificial
  heavy chain of PD-L1-PLGLAG-IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccgctgggcctggcgggcgcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 130 - protein, 583 aa, Artificial
  heavy chain of PD-L1-PLGLAG-IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPLGLAGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 131 - DNA, 1059 bp, Artificial
  light chain of PD-L1-PLGLAG-IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcccgctgggcctggcgggcgcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 132 - protein, 353 aa, Artificial
  light chain of PD-L1-PLGLAG-IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECPLGLAGAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 133 - DNA, 1749 bp, Artificial
  heavy chain of PD-L1-PLGLAG-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactccgctgggcctggcgggcgaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 134 - protein, 583 aa, Artificial
  heavy chain of PD-L1-PLGLAG-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTPLGLAGEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 135 - DNA, 1059 bp, Artificial
  light chain of PD-L1-PLGLAG-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactccgctgggcctggcgggcgacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 136 - protein, 353 aa, Artificial
  light chain of PD-L1-PLGLAG-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTPLGLAGDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - DNA, 1869 bp, Artificial
  heavy chain of PD-L1-GIVGPL-NanoLuc (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcattgtgggaccgctgctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 138 - protein, 623 aa, Artificial
  heavy chain of PD-L1-GIVGPL-NanoLuc (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGIVGPLLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 139 - DNA, 1179 bp, Artificial
  light chain of PD-L1-GIVGPL-NanoLuc (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcattgtgggaccgctgctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 140 - protein, 393 aa, Artificial
  light chain of PD-L1-GIVGPL-NanoLuc (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGIVGPLLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 141 - DNA, 1863 bp, Artificial
  heavy chain of PD-L1-GIVGPL-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcattgtgggaccgctggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 142 - protein, 621 aa, Artificial
  heavy chain of PD-L1-GIVGPL-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGIVGPLEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 143 - DNA, 1173 bp, Artificial
  light chain of PD-L1-GIVGPL-NanoLuc (N-terminal fusion)
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgggcattgtgggaccgctggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 144 - protein, 391 aa, Artificial
  light chain of PD-L1-GIVGPL-NanoLuc (N-terminal fusion)
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILAGIVGPLDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - DNA, 1749 bp, Artificial
  heavy chain of PD-L1-GIVGPL-IL2 (C-terminal fusion)
gaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaggcattgtgggaccgctggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 146 - protein, 583 aa, Artificial
  heavy chain of PD-L1-GIVGPL-IL2 (C-terminal fusion)
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGIVGPLAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 147 - DNA, 1059 bp, Artificial
  light chain of PD-L1-GIVGPL-IL2 (C-terminal fusion)
gacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgcggcattgtgggaccgctggcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 148 - protein, 353 aa, Artificial
  light chain of PD-L1-GIVGPL-IL2 (C-terminal fusion)
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGIVGPLAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 149 - DNA, 1749 bp, Artificial
  heavy chain of PD-L1-GIVGPL-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcattgtgggaccgctggaagtccaactggtcgaaagcggtggaggtctggtacagccaggaggaagtttgagactgtcatgcgctgcttccgggtttactttcagcgactcctggattcactgggttcgtcaggcacctggaaaggggcttgagtgggttgcatggatttccccatacggcggctctacatactacgctgacagcgtcaagggcaggtttacaataagcgccgatacctctaaaaacaccgcctacctgcagatgaatagtttgcgagccgaggataccgccgtgtattattgtgcccggcgccattggcccggcggcttcgattattgggggcaggggacacttgtgacagtgtctgcagcctctaccaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 150 - protein, 583 aa, Artificial
  heavy chain of PD-L1-GIVGPL-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGIVGPLEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 151 - DNA, 1059 bp, Artificial
  light chain of PD-L1-GIVGPL-IL2 (N-terminal fusion)
gcacctacctcgagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgactggcattgtgggaccgctggacatccagatgacccaatccccatcctccttgagcgcatctgtaggagacagagtcaccatcacctgcagggcttcacaggatgttagcacagctgtggcttggtaccagcagaaacctggaaaggccccaaaactgctgatatacagcgcctcattcctgtacagcggagtgccctctcgctttagtggctctgggagtggcactgatttcacactgactatttctagtctgcagcccgaagatttcgccacttactattgccagcagtatctctatcaccccgccacctttgggcagggcacaaaggtcgagattaagcgtacggtggccgctcccagcgtgttcatcttcccacccagcgacgagcagctgaagtctggcaccgccagcgtcgtgtgcctgctgaacaacttctacccccgcgaggccaaggtgcagtggaaggtggacaacgccctgcagtccggcaacagccaggaaagcgtcaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 152 - protein, 353 aa, Artificial
  light chain of PD-L1-GIVGPL-IL2 (N-terminal fusion)
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGIVGPLDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - DNA, 1863 bp, Artificial
  heavy chain of 9G4-PVGLIG-NanoLuc (C-terminal fusion)
gaagtgatgttggtggagtctgggggaggcttagtgaagcctggagggtccctgaaactctcctgtacagcctctggattcactttcagtacctatgacatgtcttgggttcgccagactccggagaagaggctggagtgggtctcaaccattagtagtagtcgtacttacacctactattcagccagtgtgaaggggcgattcaccatctccagagacaatgccaggaacatcctgtacctgcaaatgagcagtctgaggtctgaggacacggccatgtattactgtgcaagacaattttctcactggggccaagggactctggtcactgtctctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcctcgagatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 154 - protein, 621 aa, Artificial
  heavy chain of 9G4-PVGLIG-NanoLuc (C-terminal fusion)
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGLEMVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 155 - DNA, 1551 bp, Artificial
  heavy chain of 9G4-PVGLIG-CCL4 (C-terminal fusion)
gaagtgatgttggtggagtctgggggaggcttagtgaagcctggagggtccctgaaactctcctgtacagcctctggattcactttcagtacctatgacatgtcttgggttcgccagactccggagaagaggctggagtgggtctcaaccattagtagtagtcgtacttacacctactattcagccagtgtgaaggggcgattcaccatctccagagacaatgccaggaacatcctgtacctgcaaatgagcagtctgaggtctgaggacacggccatgtattactgtgcaagacaattttctcactggggccaagggactctggtcactgtctctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcgcaccaatgggctcagaccctcccaccgcctgctgcttttcttacaccgcgaggaaacttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaac

SEQ ID NO: 156 - protein, 517 aa, Artificial
  heavy chain of 9G4-PVGLIG-CCL4 (C-terminal fusion)
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGAPMGSDPPTACCFSYTARKLPRNFVVDYYETSSLCSQPAVVFQTKRSKQVCADPSESWVQEYVYDLELN

SEQ ID NO: 157 - DNA, 1686 bp, Artificial
  heavy chain of 9G4-PVGLIG-IL15 (C-terminal fusion)
gaagtgatgttggtggagtctgggggaggcttagtgaagcctggagggtccctgaaactctcctgtacagcctctggattcactttcagtacctatgacatgtcttgggttcgccagactccggagaagaggctggagtgggtctcaaccattagtagtagtcgtacttacacctactattcagccagtgtgaaggggcgattcaccatctccagagacaatgccaggaacatcctgtacctgcaaatgagcagtctgaggtctgaggacacggccatgtattactgtgcaagacaattttctcactggggccaagggactctggtcactgtctctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 158 - protein, 562 aa, Artificial
  heavy chain of 9G4-PVGLIG-IL15 (C-terminal fusion)
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 159 - DNA, 1839 bp, Artificial
  heavy chain of 9G4-PVGLIG-IFNalpha (C-terminal fusion)
gaagtgatgttggtggagtctgggggaggcttagtgaagcctggagggtccctgaaactctcctgtacagcctctggattcactttcagtacctatgacatgtcttgggttcgccagactccggagaagaggctggagtgggtctcaaccattagtagtagtcgtacttacacctactattcagccagtgtgaaggggcgattcaccatctccagagacaatgccaggaacatcctgtacctgcaaatgagcagtctgaggtctgaggacacggccatgtattactgtgcaagacaattttctcactggggccaagggactctggtcactgtctctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggctgtgatctgcctcaaacccacagcctgggtagcaggaggaccttgatgctcctggcacagatgaggaaaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 160 - protein, 613 aa, Artificial
  heavy chain of 9G4-PVGLIG-IFNalpha (C-terminal fusion)
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 161 - DNA, 1698 bp, Artificial; identical to SEQ ID NO: 51
  heavy chain of NHS76-PVGLIG-IL15 (C-terminal fusion)

SEQ ID NO: 162 - protein, 566 aa, Artificial; identical to SEQ ID NO: 52
  heavy chain of NHS76-PVGLIG-IL15 (C-terminal fusion)

SEQ ID NO: 163 - DNA, 1704 bp, Artificial
  heavy chain of H16/L16-PVGLIG-IL15 (C-terminal fusion)
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 164 - protein, 568 aa, Artificial; identical to SEQ ID NO: 50
  heavy chain of H16/L16-PVGLIG-IL15 (C-terminal fusion)

SEQ ID NO: 165 - DNA, 12 bp, Artificial
  linker
tcaggcagatct

SEQ ID NO: 166 - protein, 4 aa, Artificial
  linker
SGRS

SEQ ID NO: 167 - DNA, 15 bp, Artificial
  linker
tcaggcagatctgcc

SEQ ID NO: 168 - protein, 5 aa, Artificial
  linker
SGRSA

SEQ ID NO: 169 - DNA, 24 bp, Artificial
  linker
ccgagcagccggagaagagtgaac

SEQ ID NO: 170 - protein, 8 aa, Artificial
  linker
PSSRRRVN

SEQ ID NO: 171 - DNA, 447 bp, Homo sapiens
aaacccatcaccggcaccatcaacgacctgaaccagcaagtgtggacactgcagggccagaatctggtggccgtgcctagaagcgatagcgtgacacctgtgaccgtggccgtgatcacatgcaagtaccccgaggctcttgagcaaggcagaggcgatcctatctacctgggcattcagaaccccgagatgtgcctgtactgcgagaaagtgggagagcagcccacactgcagctgaaagaacagaaaatcatggacctgtacggccagcctgagcctgtgaagcccttcctgttttacagagccaagaccggccggaccagcacactggaatctgtggcctttcctgactggtttatcgccagcagcaagcgggaccagcctatcatcctgacaagcgagctgggcaagagctacaacaccgccttcgagctgaacatcaacgat

SEQ ID NO: 172 - protein, 149 aa, Homo sapiens
KPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 173 - DNA, 1869 bp, Artificial
  H16/L16-PVGLIG-IL36G heavy chain
atggaaaccgacaccctgctgctgtgggtgctgctgctctgggtcccaggctctaccggccaggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaaacccatcaccggcaccatcaacgacctgaaccagcaagtgtggacactgcagggccagaatctggtggccgtgcctagaagcgatagcgtgacacctgtgaccgtggccgtgatcacatgcaagtaccccgaggctcttgagcaaggcagaggcgatcctatctacctgggcattcagaaccccgagatgtgcctgtactgcgagaaagtgggagagcagcccacactgcagctgaaagaacagaaaatcatggacctgtacggccagcctgagcctgtgaagcccttcctgttttacagagccaagaccggccggaccagcacactggaatctgtggcctttcctgactggtttatcgccagcagcaagcgggaccagcctatcatcctgacaagcgagctgggcaagagctacaacaccgccttcgagctgaacatcaacgat

SEQ ID NO: 174 - protein, 623 aa, Artificial
  H16/L16-PVGLIG-IL36G heavy chain
METDTLLLWVLLLWVPGSTGQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 175 - DNA, 1626 bp, Artificial
  9G4-SGRS-hCXCL10 heavy chain
atgaacttcggactctccctgatcttccttgttctggtgcttaagggcgtgcagtgcgaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcct

SEQ ID NO: 176 - protein, 542 aa, Artificial
  9G4-SGRS-hCXCL10 heavy chain
MNFGLSLIFLVLVLKGVQCEVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSVPLSRTVRCTCISISNQPVNPRSLEKLEIIPASQFCPRVEIIATMKKKGEKRCLNPESKAIKNLLKAVSKERSKRSP

SEQ ID NO: 177 - DNA, 1641 bp, Artificial
  NHS76-SGRS-hCXCL10 heavy chain
atggaaaccgacaccctgctgctgtgggtgctgctgctctgggtcccaggctctaccggccaggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcct

SEQ ID NO: 178 - protein, 547 aa, Artificial
  NHS76-SGRS-hCXCL10 heavy chain
METDTLLLWVLLLWVPGSTGQVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSVPLSRTVRCTCISISNQPVNPRSLEKLEIIPASQFCPRVEIIATMKKKGEKRCLNPESKAIKNLLKAVSKERSKRSP

SEQ ID NO: 179 - DNA, 1647 bp, Artificial
  H16L16-SGRS-hCXCL10 heavy chain
atggaaaccgacaccctgctgctgtgggtgctgctgctctgggtcccaggctctaccggccaggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcct

SEQ ID NO: 180 - protein, 549 aa, Artificial
  H16L16-SGRS-hCXCL10 heavy chain
METDTLLLWVLLLWVPGSTGQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSVPLSRTVRCTCISISNQPVNPRSLEKLEIIPASQFCPRVEIIATMKKKGEKRCLNPESKAIKNLLKAVSKERSKRSP

SEQ ID NO: 181 - DNA, 1761 bp, Artificial
  H16L16-SGRSA-hIL15 heavy chain
atggaaaccgacaccctgctgctgtgggtgctgctgctctgggtcccaggctctaccggccaggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 182 - protein, 587 aa, Artificial
  H16L16-SGRSA-hIL15 heavy chain
METDTLLLWVLLLWVPGSTGQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 183 - DNA, 1914 bp, Artificial
  H16L16-SGRSA-hIFNa heavy chain
atggaaaccgacaccctgctgctgtgggtgctgctgctctgggtcccaggctctaccggccaggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgcctgtgatctgcctcaaacccacagcctgggtagcaggaggaccttgatgctcctggcacagatgaggaaaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 184 - protein, 638 aa, Artificial
  H16L16-SGRSA-hIFNa heavy chain
METDTLLLWVLLLWVPGSTGQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSACDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 185 - DNA, 1923 bp, Artificial
  H16L16-PSSRRRVN-hIFNa heavy chain
atggaaaccgacaccctgctgctgtgggtgctgctgctctgggtcccaggctctaccggccaggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccgagcagccggagaagagtgaactgtgatctgcctcaaacccacagcctgggtagcaggaggaccttgatgctcctggcacagatgaggaaaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 186 - protein, 641 aa, Artificial
  H16L16-PSSRRRVN-hIFNa heavy chain
METDTLLLWVLLLWVPGSTGQVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPSSRRRVNCDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 187 - DNA, 657 bp, Artificial
  m9G4 Complete Light Chain
cgtacggtgatgactcaaacccctctgaccctcagcgtgacgatcgggcagcccgctagtattagctgtaagagtagccagtctctcctggattctgatggcaagacttatctgaactggctgttgcagcgacctggtcagtcaccgacacggctcatatatctggtatccaaactcgactccggcgtgccagacagattcaccggatctggctcaggcacagactttacactgaaaatctccagggtcgaggcagaggaccttggggtttactactgctggcagggaacccactttccacatacattcggtggcggaaccaaactggaaatcaagcgtacggtggccgctcccagcgtgttcatcttccccccaagcgacgagcagctgaagagcggcaccgccagcgtggtgtgtctgctgaacaacttctaccccagggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcacaaggtgtacgcctgtgaggtgacccaccagggcctgtccagccccgtgaccaagagcttcaacaggggcgagtgc

SEQ ID NO: 188 - protein, 219 aa, Artificial
  m9G4 Complete Light Chain
DVVMTQTPLTLSVTIGQPASISCKSSQSLLDSDGKTYLNWLLQRPGQSPTRLIYLVSKLDSGVPDRFTGSGSGTDFTLKISRVEAEDLGVYYCWQGTHFPHTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - DNA, 1344 bp, Artificial
  Ganitumab_IgG1 Complete Heavy Chain
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggc

SEQ ID NO: 190 - protein, 448 aa, Artificial
  Ganitumab_IgG1 Complete Heavy Chain
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 191 - DNA, 1335 bp, Artificial
  Ganitumab_IgG4 Complete Heavy Chain
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 192 - protein, 445 aa, Artificial
  Ganitumab_IgG4 Complete Heavy Chain
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 193 - DNA, 1326 bp, Artificial
  m9G4_IgG1 Complete Heavy Chain
gaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggc

SEQ ID NO: 194 - protein, 442 aa, Artificial
  m9G4_IgG1 Complete Heavy Chain
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 195 - DNA, 1317 bp, Artificial
  m9G4_IgG4 Complete Heavy Chain
gaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctggga

SEQ ID NO: 196 - protein, 439 aa, Artificial
  m9G4_IgG4 Complete Heavy Chain
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 197 - DNA, 1338 bp, Artificial
  hNHS76_IgG1 Complete Heavy Chain
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggc

SEQ ID NO: 198 - protein, 446 aa, Artificial
  hNHS76_IgG1 Complete Heavy Chain
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 199 - DNA, 1211 bp, Artificial
  hNHS76_IgG4 Complete Heavy Chain
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgta

SEQ ID NO: 200 - protein, 442 aa, Artificial; identical to SEQ ID NO: 194
  hNHS76_IgG4 Complete Heavy Chain

SEQ ID NO: 201 - DNA, 36 bp, Artificial
  linker
cctgtcggactcatcggaccggtgggcctgattggc

SEQ ID NO: 202 - protein, 12 aa, Artificial
  linker
PVGLIGPVGLIG

SEQ ID NO: 203 - DNA, 90 bp, Artificial
  linker
ggaggcggaggatctggtggtggtggatctggcggcggaggaagtggcggaggcggaagcggtggtggcggttcaggtggcggagctagc

SEQ ID NO: 204 - protein, 30 aa, Artificial
  linker
GGGGSGGGGSGGGGSGGGGSGGGGSGGGAS

SEQ ID NO: 205 - DNA, 195 bp, Homo sapiens
atcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcaga

SEQ ID NO: 206 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 207 - DNA, 231 bp, Homo sapiens
atcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagaccccgccctggtgcaccagcggcccgcccccccc

SEQ ID NO: 208 - protein, 77 aa, Homo sapiens
ITCPPPMSVEHADIWVKSYSLYSRERYICNSGFKRKAGTSSLTECVLNKATNVAHWTTPSLKCIRDPALVHQRPAPP

SEQ ID NO: 209 - DNA, 525 bp, Homo sapiens
atcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagatcccgctctggtccatcagaggcctgctcctccatctacagtgacaacagctggcgtgacccctcagcctgagtctctgtctccatctggaaaagagcctgccgccagctctcccagctctaacaatactgctgccaccacagccgccatcgtgcctggatctcagctgatgcctagcaagagccctagcaccggcacaacagagatcagctctcacgagtctagccacggcaccccatctcagaccacagccaagaattgggaactgaccgcctctgcctctcatcagccacctggtgtttaccctcaaggccactctgataccacc

SEQ ID NO: 210 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 211 - DNA, 1695 bp, Artificial
  Ganitumab_IgG4_Heavy Chain_PVGLIG_IL15
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 212 - protein, 565 aa, Artificial
  Ganitumab_IgG4_Heavy Chain_PVGLIG_IL15
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 213 - DNA, 1677 bp, Artificial
  m9G4_IgG4_Heavy Chain_PVGLIG_IL15
gaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 214 - protein, 559 aa, Artificial
  m9G4_IgG4_Heavy Chain_PVGLIG_IL15
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 215 - DNA, 1689 bp, Artificial
  NHS76_IgG4_Heavy Chain_PVGLIG_IL15
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 216 - protein, 563 aa, Artificial
  NHS76_IgG4_Heavy Chain_PVGLIG_IL15
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 217 - DNA, 1701 bp, Artificial
  Ganitumab_IgG1_Heavy Chain_SGRSA_IL15
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggctcaggcagatctgccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 218 - protein, 567 aa, Artificial
  Ganitumab_IgG1_Heavy Chain_SGRSA_IL15
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGSGRSANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 219 - DNA, 1722 bp, Artificial
  Ganitumab_IgG1_Heavy Chain_PVGLIG_IPVGLIG_L15
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggccctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 220 - protein, 574 aa, Artificial
  Ganitumab_IgG1_Heavy Chain_PVGLIG_IPVGLIG_L15
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 221 - DNA, 1713 bp, Artificial
  Ganitumab_IgG4_Heavy Chain_PVGLIG_IPVGLIG_L15
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggacctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 222 - protein, 571 aa, Artificial
  Ganitumab_IgG4_Heavy Chain_PVGLIG_IPVGLIG_L15
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 223 - DNA, 1704 bp, Artificial
  m9G4_IgG1_Heavy Chain_PVGLIG_IPVGLIG_L15
gaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggccctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 224 - protein, 568 aa, Artificial
  m9G4_IgG1_Heavy Chain_PVGLIG_IPVGLIG_L15
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 225 - DNA, 1695 bp, Artificial
  m9G4_IgG4_Heavy Chain_PVGLIG_IPVGLIG_L15
gaagtgatgttggtagaaagcggtggtgggctggtgaaacctggcgggtccctgaaactctcctgtactgctagtggattcacattcagcacttacgacatgtcatgggtccggcagaccccagagaagagactggagtgggtcagcactatctcctcttctcggacctatacgtattacagtgccagcgtcaagggacgctttaccattagcagggataatgccagaaacatactgtacctgcagatgtcaagcctccgaagtgaggacaccgccatgtattactgcgctaggcaattttcacactggggccaggggacattggttaccgtgtctgcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggacctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 226 - protein, 565 aa, Artificial
  m9G4_IgG4_Heavy Chain_PVGLIG_IPVGLIG_L15
EVMLVESGGGLVKPGGSLKLSCTASGFTFSTYDMSWVRQTPEKRLEWVSTISSSRTYTYYSASVKGRFTISRDNARNILYLQMSSLRSEDTAMYYCARQFSHWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 227 - DNA, 1716 bp, Artificial
  NHS76_IgG1_Heavy Chain_PVGLIG_IPVGLIG_L15
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggccctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 228 - protein, 474 aa, Artificial
  NHS76_IgG1_Heavy Chain_PVGLIG_IPVGLIG_L15
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGPVGLIGNWVNVISDLKKIEDLI

SEQ ID NO: 229 - DNA, 1707 bp, Artificial
  NHS76_IgG4_Heavy Chain_PVGLIG_IPVGLIG_L15
caggtgcagctgcaggagtccggcccaggactggtgaagccttcggagaccctgtccctcacctgcgctgtctctggttactccatcagcagtggttactactggggctggattcggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcaagagggaagtggtcgaagtttgactattggggccaaggcaccctggtcaccgtctcttcagcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggacctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttct

SEQ ID NO: 230 - protein, 569 aa, Artificial
  NHS76_IgG4_Heavy Chain_PVGLIG_IPVGLIG_L15
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARGKWSKFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 231 - DNA, 1989 bp, Artificial
  Ganitumab_IgG1_Heavy Chain_PVGLIG_IL15 [nc30-Sushi]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcaga

SEQ ID NO: 232 - protein, 663 aa, Artificial
  Ganitumab_IgG1_Heavy Chain_PVGLIG_IL15 [nc30-Sushi]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIR

SEQ ID NO: 233 - DNA, 1980 bp, Artificial
  Ganitumab_IgG4_Heavy Chain_PVGLIG_IL15 [nc30-Sushi]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcaga

SEQ ID NO: 234 - protein, 660 aa, Artificial
  Ganitumab_IgG4_Heavy Chain_PVGLIG_IL15 [nc30-Sushi]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIR

SEQ ID NO: 235 - DNA, 2025 bp, Artificial
  Ganitumab_IgG1_Heavy Chain_PVGLIG_IL15 [nc30-Sushi+]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggcccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagaccccgccctggtgcaccagcggcccgcccccccc

SEQ ID NO: 236 - protein, 675 aa, Artificial
  Ganitumab_IgG1_Heavy Chain_PVGLIG_IL15 [nc30-Sushi+]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIRDPALVHQRPAPP

SEQ ID NO: 237 - DNA, 2016 bp, Artificial
  Ganitumab_IgG4_Heavy Chain_PVGLIG_IL15 [nc30-Sushi+]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggccccagcgtgttccctctggccccctgcagcagaagcaccagcgagtctacagccgccctgggatgcctggtcaaggactacttccccgagcccgtgaccgtgtcctggaactctggcgccctgaccagcggcgtgcacacctttccagccgtgctgcagagcagcggcctgtacagcctgagcagcgtcgtgaccgtgcctagcagcagcctgggcaccaagacctacacctgtaacgtggaccacaagcccagcaacaccaaggtggacaagcgggtggaatctaagtacggccctccctgccccccctgcccagcccctgaatttctgggcggaccctccgtgttcctgttccccccaaagcccaaggacaccctgatgatcagccggacccccgaagtgacctgcgtggtggtggacgtgtcccaggaagatcccgaggtccagttcaactggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtctccaacaagggcctgcccagctccatcgagaaaaccatcagcaaggccaagggccagccccgcgagccccaggtgtacacactgccccccagccaggaagagatgaccaagaaccaggtgtccctgacctgcctcgtgaagggcttctaccccagcgatatcgccgtggaatgggagagcaacggccagcccgagaacaactacaagaccaccccccctgtgctggacagcgacggcagcttcttcctgtactcccggctgaccgtcgacaagagccggtggcaggaaggcaacgtcttcagctgcagcgtgatgcacgaggccctgcacaaccactacacccagaagtccctgagcctgagcctgggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagaccccgccctggtgcaccagcggcccgcccccccc

SEQ ID NO: 238 - protein, 672 aa, Artificial
  Ganitumab_IgG4_Heavy Chain_PVGLIG_IL15 [nc30-Sushi+]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIRDPALVHQRPAPP

SEQ ID NO: 239 - DNA, 2007 bp, Artificial
  Ganitumab_IgG1_Heavy Chain_PVGLIG_PVGLIG_IL15 [nc30-Sushi]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggccctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcaga

SEQ ID NO: 240 - protein, 669 aa, Artificial
  Ganitumab_IgG1_Heavy Chain_PVGLIG_PVGLIG_IL15 [nc30-Sushi]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIR

SEQ ID NO: 241 - DNA, 2043 bp, Artificial
  Ganitumab_IgG1_Heavy Chain_PVGLIG_PVGLIG_IL15 [nc30-Sushi+]
caggtgcagctgcaggagtcgggaccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagatggaccgggcgtactgatgcttttgatatctggggccaagggacaatggtcaccgtctcaagcgcgtccacaaagggcccaagcgtgttcccgctagcccccagcagcaagagcaccagcggcggcacagccgccctgggctgcctggtgaaggactacttccccgagcccgtgaccgtgtcctggaacagcggagccctgacctccggcgtgcacaccttccccgccgtgctgcagagcagcggcctgtacagcctgagcagcgtggtgaccgtgcccagcagcagcctgggcacccagacctacatctgtaacgtgaaccacaagcccagcaacaccaaggtggacaagagagtggagcccaagagctgtgacaagacccacacctgtcccccctgcccagcccccgagctgctgggcggacccagcgtgttcctgttcccccccaagcccaaggacaccctgatgatcagcagaacccccgaggtgacctgtgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaggagtacaagtgtaaggtgtccaacaaggccctgccagccccaatcgaaaagaccatcagcaaggccaagggccagccaagagagccccaggtgtacaccctgccacccagcagggaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaagctgaccgtggacaagagcagatggcagcagggcaacgtgttcagctgctccgtgatgcacgaggccctgcacaaccactacacccagaagagcctgagcctgtccccaggccctgtcggactcatcggaccggtgggcctgattggcaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttctggaggcggaggatctggtggtggtggatctggcggcggaggaagtggcggaggcggaagcggtggtggcggttcaggtggcggagctagcatcacctgtcctccacctatgagcgtggaacacgccgacatctgggtcaagagctacagcctgtacagcagagagcggtacatctgcaacagcggcttcaagagaaaggccggcacaagcagcctgaccgagtgtgtgctgaacaaggccacaaacgtggcccactggaccacacctagcctgaagtgcatcagagaccccgccctggtgcaccagcggcccgcccccccc

SEQ ID NO: 242 - protein, 681 aa, Artificial
  Ganitumab_IgG1_Heavy Chain_PVGLIG_PVGLIG_IL15 [nc30-Sushi+]
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPVGLIGPVGLIGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSGGGGSGGGGSGGGGSGGGGSGGGASITCPPPMSVEHADIWVKSYSLYSRERYICNSGFKRKAGTSSLTECVLNKATNVAHWTTPSLKCIRDPALVHQRPAPP

---

The invention claimed is:

1. A fusion protein comprising:
   an antibody which binds a tumour-associated antigen (TAA) or a tumour-specific antigen (TSA), or antigen-binding fragment thereof, fused to
   (ii) a cleavable peptide linker, wherein the cleavable peptide linker comprises a tumor-associated protease cleavage site and
   (iii) a cytokine, or functional fragments thereof.

2. The fusion protein of claim 1, wherein the antibody or antigen-binding fragment thereof is selected from the group consisting of polyclonal antibodies, monoclonal antibodies, chimeric antibodies, humanised antibodies, scFv, single domain antibodies, maxibodies, minibodies, intrabodies, diabodies, triabodies, tetrabodies, v-NAR and bis-scFv.

3. The fusion protein of claim 1, wherein the protease cleavage site is cleaved by a matrix metalloproteinase or by uPA.

4. The fusion protein of claim 3, wherein the matrix metalloproteinase is MMP-2, MMP-9.

5. The fusion protein of claim 1, wherein the cleavable peptide linker has a sequence selected from the group consisting of: GPLGIAGQ (SEQ ID NO: 38), GPLGLWAQ (SEQ ID NO: 40), GPLGMLSQ (SEQ ID NO: 42), PLGLAG (SEQ ID NO: 36), PVGLIG (SEQ ID NO: 44), SGRS (SEQ ID NO: 166), SGRSA (SEQ ID NO: 168), and PSSRRRVN (SEQ ID NO: 170).

6. The fusion protein of claim 1, wherein the cytokine is a human cytokine or a functional fragment thereof.

7. The fusion protein of claim 1, wherein the cytokine is selected in the group consisting of: IL-1, IL-2, IL-3, IL-4, IL-5, IL-6, IL-7, IL-8, IL-9, IL-10, IL-11, IL-12, IL-13, IL-15, IL-16, IL-17, IL-18, IL-19, IL-20, IL-21, IL-22, IL-23, IL-24, IL-26, IL-28, IL-29, IL-33, IL-36, IL-37, IL-38, IFN-α (including IFN-α1/13, IFN-α2, IFN-α4, IFN-α5, IFN-α6, IFN-α7, IFN-α8, IFN-α10, IFN-α14, IFN-α16, IFN-α17, and IFN-α21), IFN-β, IFN-γ, IFN-λ, TNF-α, TNF-β, TGF-β1, M-CSF, G-CSF, GM-CSF, and CXL10.

8. The fusion protein of claim 1, wherein the cytokine is selected in the group consisting of: IL-15, CXCL10, IL-36, and IFN-α.

9. The fusion protein of claim 1, wherein:
   (i) the cytokine, or functional fragment thereof is fused to the cleavable peptide linker, and
   (ii) the cleavable peptide linker is used N-terminally or C-terminally to the light chain of the antibody or antigen-binding fragment thereof.

10. The fusion protein of claim 1, wherein:
    the cytokine, or functional fragment thereof is fused to the cleavable peptide linker, and
    (ii) the cleavable peptide linker is fused N-terminally or C-terminally to the heavy chain of the antibody or antigen-binding fragment thereof.

11. A pharmaceutical composition comprising a fusion protein of claim 1 and a pharmaceutically acceptable excipient.

* * * * *